(12) United States Patent
Bertonati et al.

(10) Patent No.: US 10,472,396 B2
(45) Date of Patent: Nov. 12, 2019

(54) MODULAR BASE-SPECIFIC NUCLEIC ACID BINDING DOMAINS FROM BURKHOLDERIA RHIZOXINICA PROTEINS

(71) Applicant: CELLECTIS, Paris (FR)

(72) Inventors: Claudia Bertonati, Paris (FR); Philippe Duchateau, Draveil (FR); Alexandre Juillerat, Paris (FR); George Silva, Le Plessis-Trevise (FR); Julien Valton, Charenton-le-Pont (FR)

(73) Assignee: CELLECTIS, Paris (FR)

( * ) Notice: Subject to any disclaimer, the term of this patent is extended or adjusted under 35 U.S.C. 154(b) by 0 days.

(21) Appl. No.: 14/696,920

(22) Filed: Apr. 27, 2015

(65) Prior Publication Data

US 2015/0225465 A1    Aug. 13, 2015

Related U.S. Application Data

(63) Continuation of application No. 13/949,880, filed on Jul. 24, 2013, now abandoned.

(60) Provisional application No. 61/759,744, filed on Feb. 1, 2013, provisional application No. 61/675,160, filed on Jul. 24, 2012.

(51) Int. Cl.
| | | |
|---|---|---|
| C12N 9/22 | (2006.01) | |
| C12N 15/62 | (2006.01) | |
| C07K 14/195 | (2006.01) | |
| A01K 67/027 | (2006.01) | |
| C12N 15/87 | (2006.01) | |
| C12N 15/90 | (2006.01) | |

(52) U.S. Cl.
CPC ........ *C07K 14/195* (2013.01); *A01K 67/0275* (2013.01); *C12N 9/22* (2013.01); *C12N 15/62* (2013.01); *C12N 15/87* (2013.01); *C12N 15/902* (2013.01); *C12N 15/907* (2013.01); *C12Y 301/21* (2013.01); *A01K 2217/07* (2013.01); *C07K 2319/80* (2013.01)

(58) Field of Classification Search
None
See application file for complete search history.

(56) References Cited

U.S. PATENT DOCUMENTS

| | | | |
|---|---|---|---|
| 2011/0165679 A1* | 7/2011 | Gordon-Kamm | C07K 14/415 435/441 |
| 2011/0301073 A1 | 12/2011 | Gregory et al. | |
| 2013/0274129 A1 | 10/2013 | Katzen et al. | |

FOREIGN PATENT DOCUMENTS

| | | |
|---|---|---|
| WO | WO 2011/146121 A1 | 11/2011 |
| WO | WO 2013/152220 A2 | 10/2013 |
| WO | WO 2013/152220 A3 | 10/2013 |

OTHER PUBLICATIONS

U.S. Appl. No. 61/644,975, filed May 9, 2012, Specification, Addendums 1 and 2, Sequence Listing, Claims and Abstract.*

(Continued)

*Primary Examiner* — Richard C Ekstrom
(74) *Attorney, Agent, or Firm* — Arrigo, Lee, Guttman & Mouta-Bellum LLP

(57) ABSTRACT

The present invention concerns new modular base-per-base specific nucleic acid binding domains (MBBBD) derived from newly identified proteins from the bacterial endosymbiont *Burkholderia Rhizoxinica* and their use for engineering nucleic acid processing enzymes, such as specific endonucleases or transcription activators.

13 Claims, 25 Drawing Sheets

Specification includes a Sequence Listing.

(56) References Cited

OTHER PUBLICATIONS

Arnould, S. et al., "Engineering of large number of highly specific homing endonucleases that induce recombination on novel DNA targets", J. Mol. Biol, (2006); vol. 355:3; pp. 443-458.
Arnould, S. et al., "The 1-CreI meganuclease and its engineered derivatives: applications from cell modification to gene therapy", Protein Eng. Des. Sel. (2011); vol. 24:1-2; pp. 27-31.
Baker, M. "Gene-editing nucleases", Nat Methods (2012); vol. 9(1); pp. 23-26.
Boch, J. et al., "Breaking the code of DNA binding specificity of TAL-type III effectors", Science (2009); vol. 326:5959; pp. 1509-1512.
Bogdanove, A. J. et al., "TAL effectors: customizable proteins for DNA targeting", Science (2011); vol. 333:6051; pp. 1843-1846.
Bustos, S. A. et al., "Functional domains of the AraC protein"; Proc. Natl. Acad .Sci. USA (1993); vol. 90:12; pp. 5638-5642.
Cermak, T. et al., "Efficient design and assembly of custom TALEN and other TAL effector-based constructs for DNA targeting", Nucleic Acids Res (2010); vol. 39:12; pp. e82 (12 pgs).
Chames, P. et al. "In vivo selection of engineered homing endonucleases using double-strand break induced homologous recombination", Nucleic Acids Res (2005); vol. 33:20; e178 (10 pgs).
Christian, M. et al., "Targeting DNA double-strand breaks with TAL effector nucleases", Genetics (2010); vol. 186:2; pp. 757-761.
Critchlow, S. E. et al., "DNA end-joining: from yeast to man", Trends Biochem Sci (1998); vol. 23:10; pp. 394-398.
Deng, D. et al. "Structural basis for sequence-specific recognition of DNA by TAL effectors", Science (2012); vol. 335:6069, pp. 720-723.
Doyle, E. L. et al., (2012). "TAL Effector-Nucleotide Targeter (TALE-NT) 2.0:tools for TAL effector design and target prediction", Nucleic Acids Res (2012); vol. 40(Web Server issue); pp. W117-W122.
Epinat, J. C.(2003). "A novel engineered meganuclease induces homologous recombination in yeast and mammalian cells", Nucleic Acids Res (2003); vol. 31:11; pp. 2952-2962.
Geissler, R. et al., "Transcriptional activators of human genes with programmable DNA-specificity", PLoS One (2011); vol. 6:5; pp. e19509 (7 pgs).
Grizot, S. et al., "Generation of redesigned homing endonucleases comprising DNA-binding domains derived from two different scaffolds", Nucleic Acids Res (2010); vol. 38:6); pp. 2006-2018.
Huang, P. et al., "Heritable gene targeting in zebrafish using customized TALENs", Nat Biotechnol (2011); vol. 29:8; pp. 699-700.
Kim, Y. G. et al., "Hybrid restriction enzymes: zinc finger fusions to Fok I cleavage domain", Proc Natl Acad Sci USA (1996); vol. 93:3; pp. 1156-1160.
Lackner, G. et al., "Complete genome sequence of Burkholderia rhizoxinica, an Endosymbiont of Rhizopus microsporus", J Bacterial (2011); vol. 193:3; pp. 783-784.
Li, L. et al. "Rapid and highly efficient construction of TALE-based transcriptional regulators and nucleases for genome modification", Plant Mol Biol. (2012); vol. 78:4-5; pp. 407-416.
Li L. et al. "Functional domains in Fok I restriction endonuclease", Proc Natl Acad Sci USA (1992); vol. 89:10); pp. 4275-4279.
Li, T.et al. "TAL nucleases (TALNs): hybrid proteins composed of TAL effectors and FokI DNA-cleavage domain", Nucleic Acids Res (2011); vol. 39:1; pp. 359-372.
Ma, J. L. et al. "Yeast Mre11 and Rad1 proteins define a Ku-independent mechanism to repair double-strand breaks lacking overlapping end sequences", Mol Cell Biol (2003); vol. 23:23; pp. 8820-8828.
Mahfouz, M. M. et al. "Targeted transcriptional repression using a chimeric TALE-SRDX repressor protein", Plant Mol Biol (2012); vol. 78:3; pp. 311-321.
Mahfouz, M. M. "De novo-engineered transcription activator-like effector (TALE) hybrid nuclease with novel DNA binding specificity creates double-strand breaks", Proc. Natl. Acad. Sci. USA (2011); vol. 108:6; pp. 2623-2628.
Mak, A. N. et al., "The crystal structure of TAL effector PthXo1 bound to its DNA target", Science (2012); vol. 335:6069; pp. 716-719.
Miller, J. C. et al., "A TALE nuclease architecture for efficient genome editing", Nat Biotechnol (2011); vol. 29:2; pp. 143-150.
Morbitzer, R. et al. "Assembly of custom TALE-type DNA binding domains by modular cloning", Nucleic Acids Res (2011); vol. 39:13; pp. 5790-5799.
Moscou, M. J. et al., "A simple cipher governs DNA recognition by TAL effectors", Science (2009); vol. 326:5959; p. 1501.
Mussolino, C., et al. "A novel TALE nuclease scaffold enables high genome editing activity in combination with low toxicity", Nucleic Acids Res (2011); vol. 39:21; pp. 9283-9293.
Sander, J. D. et al., "Targeted gene disruption in somatic zebrafish cells using engineered TALENs", Nat Biotechnol (2011); vol. 29:8; pp. 697-698.
Smith, J. et al. A combinatorial approach to create artificial homing endonucleases cleaving chosen sequences, Nucleic Acids Res (2006); vol. 34:22; pp. e149 (12 pgs).
Stoddard, B. L. et al., "Advances in engineering homing endonucleases for gene targeting : ten years after structures", Progress in Gene Therapy:Autologous (2007); Ch. 6; pp. 135-167.
Tesson, L. et al., "Knockout rats generated by embryo microinjection of TALENs", Nat Biotechnol (2011); vol. 29:8; pp. 695-696.
Weber, E. et al., "Assembly of designer TAL effectors by Golden Gate cloning", PLoS One (2011); vol. 6:5; e19722 (5 pgs).
Zhang, F. et al., "Efficient construction of sequence-specific TAL effectors for modulating mammalian transcription", Nat Biotechnol (2011); vol. 29:2; pp. 149-153.
International Search Report and Written Opinion dated May 14, 2014 in PCT/US2013/051783.
"SubName: Full=Plasmid pBRH01, complete sequence;" DATABASE UniProt [Online], vol. E5AV36, XP002723337, Feb. 8, 2011, 1 Page.
"SubName: Full=Plasmid pBRH02, complete sequence;" DATABASE UniProt [Online], vol. E5AW45, XP002723338, Feb. 8, 2011, 1 Page.
"SubName: Full=Plasmid pBRH02, complete sequence;" DATABASE UniProt [Online], vol. E5AW43, XP002723339, Feb. 8, 2011, 1 Page.
Magdy M. Mahfouz, et al., "De novo-engineered transcription activator-like effector (TALE) hybrid nuclease with novel DNA binding specificity creates double-strand breaks" Proceedings of the National Academy of Sciences, vol. 108, No. 6, XP055007615, Feb. 8, 2011, pp. 2623-2628.
Heidi Scholze, et al., "Tal effectors are remote controls for gene activation" Current Opinion in Microbiology, vol. 14, No. 1, XP028359313, Jan. 5, 2011, pp. 47-53.
Boch et al., Breaking the Code of DNA Binding Specificity of TAL-Type III Effectors, Science, vol. 326, 1509-1512, Dec. 11, 2009.
Genbank Accession ACD60565.2, TAL effector AvrBs3/PthA [Xanthomonas oryzae pv. oryzae PXO99A], Nov. 16, 2015.
Genbank, Accession AAY54168.1, AvrXa27 [Xanthomonas oryzae pv. oryzae], Jun. 24, 2005.
Cermak et al., Efficient design and assembly of custom TALEN and other TAL effector-based constructs for DNA targeting, Nucleic Acids Research, 2011, vol. 39, No. 12, e82, 1-11.
De Lange et al., Programmable DNA-binding proteins from Burkholderia provide a fresh perspective on the TALE-like repeat domain, Nucleic Acids Research, 2014, vol. 42, No. 11, at 7436-49.
Juillerat et al., BurrH: a new modular DNA binding protein for genome engineering, Sci Rep. Jan. 23, 2014;4:3831, 1-6.

* cited by examiner

|                    |                                                                                                                       |
|--------------------|-----------------------------------------------------------------------------------------------------------------------|
| AvrBS3             | (SEQ ID NO: 1)                                                                                                        |
| B5AM45_BURKH       | (SEQ ID NO: 4)                                                                                                        |
| B5AV36_BURKH       | (SEQ ID NO: 2)                                                                                                        |
| B5AM43_BURKH       | (SEQ ID NO: 3)                                                                                                        |
| B5AM46_BURKH       | (SEQ ID NO: 5)                                                                                                        |

```
                      5             15             25             35             45             55
                      ....|....|....|....|....|....|....|....|....|....|....|....|
AvrBS3                ------------------------------------MGDPK KRRKVIDEPY DVPDYAIDIA DLRTLGYSQ
B5AM45_BURKH          ----------------------------------------------------------------
B5AV36_BURKH          ----------------------------------------------------------------
B5AM43_BURKH          ----------------------------------------------------------------
B5AM46_BURKH          ----------------------------------------------------------------

65            75             85             95            105            115
                      ....|....|....|....|....|....|....|....|....|....|....|....|
AvrBS3                QQQEKIKPKV RSTVAQHHEA LVGHGFTHAH IVALSQHPAA LGTVAVKYQD MIAALPEATH
B5AM45_BURKH          ----------------------------------------------M PAKSHQHDK QSANGLMLSP
B5AV36_BURKH          ----------------------------------------------M MSTDAFVDQK QMAHKLNLSP
B5AM43_BURKH          ----------------------------------------------M PVTSVYQKM PFGARLNLSP
B5AM46_BURKH          ----------------------------------------------------------------

125           135            145            155            165            175
                      ....|....|....|....|....|....|....|....|....|....|....|....|
AvrBS3                BAIVGVGKQW SG-ARALEAL LTVAGELRGP PLQLDTQQLL KIAKRGGVTA VEAVHAMRHA
B5AM45_BURKH          LERIKIERHY GGGAFL-APT SHQHBELAQV LSRADIL--- KIASTDC--- --AAQALQAV
B5AV36_BURKH          LERSKIEKQY GG-ATTLAFI SNKQHBLAQI LSRADIL--- KIASTDC--- --AABALQAV
B5AM43_BURKH          PECLKIERHS GG-ADALEFI SNKYDALTQV LSRADIL--- KIACHDC--- --AABALQAV
B5AM46_BURKH          ----MQAVL DCGPMLSKRG PSQADIV--- KIACNGG--- ---AQALYSV 185           195            205            215            225            235
                      ....|....|....|....|....|....|....|....|....|....|....|....|
AvrBS3                LTGAPLN--- -LTPEQVVAI ASHDGGKQAL ETVQRLLPVL CQAHGLTPQQ VVAIASHGGG
B5AM45_BURKH          LDCGPMLGKR GFSRADIVKI AGHGGAQAL YSVLDVEPTL GKRG-FSQVD VVKIAG--GG
B5AV36_BURKH          LDCGPMLGKR GFSQSDIVKI AGHIGGAQAL QAVLDLESHL GKRG-FSRDD IAKVAGHIGG
B5AM43_BURKH          LDYEQWFRQR GFARADIKI TCHGGGAQAL KAVVHHGPTL MECG-FSQAD IVRIADMIGG
B5AM46_BURKH          LDVEPTLRER GFSRVDIVKI AGHNGGA... .......... .......... ..........

245           255            265            275            285            295
                      ....|....|....|....|....|....|....|....|....|....|....|....|
AvrBS3                KQALETVQRL LPVLCQAHGL TPEQVVAIAS HGGGKQALRT VQALLPVLCQ AHGLTPQQVV
B5AM45_BURKH          AQALETVLEI GPTLGER-GF SRGDIVTIAG NHGGAQALQA VLELEPTLRE RG-FHQADIV
B5AV36_BURKH          AQTLQAVLDL ESAFRSR-GF SQADIVKIAG SQADIVKIAG VLDVEPTLGK RG-FSRADIV
B5AM43_BURKH          AQALKAVLEH GPTLMER-DY SGADIVKIAG NQGGAQALYS VVMGEPTLCE H-YSGADIV
B5AM46_BURKH          .......... .......... .......... .......... .......... ..........
```

```
E5AV36_1    FSQSDIVKIAGNIGGAQALQAVLDLESMLGKRG
E5AV36_15   FSQADIVKIAGNDGGTQALHAVLDLERMLGERG
E5AV36_3    FSQADIVKIAGNNGGAQALYSVLDVEPTLGKRG
E5AW45_1    FSRADIVRIAGNGGGAQALYSVLDVEPTLGKRG
E5AW45_13   FNQATIVKIAANGGAQALYSVLDVEPTLDKRG
E5AW45_16   FNQATIVKMAGNAGGAQALYSVLDVEPALRERG
E5AW45_4    FNQADIVKIAGNGGGAQALQAVLDVEPALGKRG
E5AV36_6    FSQATIAKIAGNIGGAQALQMVLDLGPALGKRG
E5AV36_7    FSQATIAKIAGNIGGAQALQTVLDLEPALCERG
E5AV36_8    FSQATIAKMAGNNGGAQALQTVLDLEPALRKRD
E5AW45_14   FSRVDIVKIAG--GGAQALHTAFELEPTLRKRG
E5AW45_17   FSQPEIVKIAGNIGGAQALHTVLELEPTLHKRG
E5AW45_2    FSQVDVVKIAG--GGAQALHTVLEIGPTLGERG
E5AV36_4    FSRADIVKIAGNTGGAQALHTVLDLEPALGKRG
E5AW45_11   FSQPEIVEMAGNIGGAQALHTVLDLELAFRERG
E5AW45_20   FSQPDIVEMAGNIGGAQALQAVLELEPAFRERG
E5AV36_2    FSRDDIAKMAGNIGGAQTLQAVLDLESAFRERG
E5AW45_8    FSQPDIVKMAGNSGGAQALQAVLDLELAFRERG
E5AW45_10   FSQANIVKMAGNSGGAQALQAVLDLELVFRERG
E5AV36_14   FSQPDIVKIAGNSGGAQALQAVLDLELTFRERG
E5AW45_7    FSQADIVKMASNIGGAQALQAVLNLEPALCERG
E5AW45_9    FSQADIVKMASNIGGAQALQAVLELEPALHERG
E5AW45_19   FGQPDIVKMASNIGGAQALQAVLELEPALRERG
E5AV36_11   FSQPDIVKMAGNIGGAQALQAVLSLGPALRERG
E5AV36_10   FNLADIVKMAGNIGGAQALQAVLDLKPVLDEHG
E5AV36_12   FSQPDIVKIAGNTGGAQALQAVLDLELTLVEHG
E5AV36_13   FSQPDIVRITGNRGGAQALQAVLALELTLRERG
E5AW45_15   FNPTDIVKIAGNKGGAQALQAVLELEPALRERG
E5AW45_18   FNPTDIVKIAGNSGGAQALQAVLELEPAFRERG
E5AW45_6    FHPTDIIKIAGNNGGAQALQAVLDLELMLRERG
E5AW45_12   VRQADIVKIVGNNGGAQALQAVFELEPTLRERG
E5AW45_21   FSQSDIVKIAGNIGGAQALQAVLELEPTLRESD
E5AW45_3    FSRGDIVTIAGNNGGAQALQAVLELEPTLRERG
E5AW45_5    FSRVDIAKIAG--GGAQALQAVLGLEPTLRKRG
E5AV36_5    FSRIDIVKIAANNGGAQALHAVLDLGPTLRECG
E5AV36_16   FSRADIVNVAGNNGGAQALKAVLEHEATLNERG
E5AV36_17   FSRADIVKIAGNGGGAQALKAVLEHEATLDERG
E5AW45_23   FNRASIVKIAGNSGGAQALQAVLKHGPTLDERG
E5AV36_9    FRQADIIKIAGNDGGAQALQAVIEHGPTLRQHG
E5AW45_22   FRQADIVNIAGNDGSTQALKAVIEHGPRLRQRG
E5AW43_1    FARADIIKITGNGGGAQALKAVVVHGPTLNECG
E5AW43_2    FARADIIKITGNGGGAQALKAVVVHGPTLNECG
E5AW43_3    YSGADIVKIAGNGGGARALKAVVMHGPTLCESG
E5AW43_4    YSGADIVKIASNGGGAQALEAVAMHGSTLCERG
E5AW43_5    YCRTDIAKIAGNGGGAQALKAIVMHGPTLCERG
E5AV36_18   FSRADIVRIAGNGGGAQALKAVLEHGPTLNERG
E5AV36_19   FNLTDIVEMAANSGGAQALKAVLEHGPTLRQRG
E5AW45_25   FNLTDIVEMAGKGGGAQALKAVLEHGPTLRQRG
E5AV36_20   LSLIDIVEIASN-GGAQALKAVLKYGPVLMQAG
E5AW45_27   LSLIDIVEIASN-GGAQALKAVLKYGPVLMQAG
E5AW45_26   FNLIDIVEMASNTGGAQALKTVLEHGPTLRQRD
E5AW45_24   FNLTNIVKIAGNGGGAQALKAVIEHGPTLQQRG
E5AW43_6    YSRTDIVKIADNNGGAQALKAVFEHGPALTQAG
            :  :.   *.::: *            :  :  .

AvrBS3      LTPEQVVAIASXXGGKQALETVQRLLPVLCQAHG
```

Fig. 2

|    | A  | C | D  | E  | F  | G  | H | I  | K  | L  | M | N  | P | Q  | R  | S  | T  | V  | W | Y | GAP |
|----|----|---|----|----|----|----|---|----|----|----|---|----|---|----|----|----|----|----|---|---|-----|
| 1  | 0  | 0 | 0  | 0  | 46 | 0  | 0 | 0  | 0  | 2  | 0 | 0  | 0 | 0  | 0  | 0  | 0  | 1  | 0 | 4 | 0   |
| 2  | 2  | 1 | 0  | 0  | 0  | 1  | 1 | 0  | 0  | 0  | 0 | 11 | 0 | 0  | 3  | 34 | 0  | 0  | 0 | 0 | 0   |
| 3  | 0  | 0 | 0  | 0  | 0  | 2  | 0 | 0  | 0  | 7  | 0 | 0  | 3 | 26 | 15 | 0  | 0  | 0  | 0 | 0 | 0   |
| 4  | 25 | 0 | 1  | 0  | 0  | 1  | 0 | 4  | 0  | 0  | 0 | 0  | 9 | 0  | 0  | 2  | 8  | 3  | 0 | 0 | 0   |
| 5  | 0  | 0 | 43 | 2  | 0  | 0  | 0 | 0  | 0  | 0  | 0 | 2  | 0 | 0  | 0  | 1  | 5  | 0  | 0 | 0 | 0   |
| 6  | 0  | 0 | 0  | 0  | 0  | 0  | 0 | 52 | 0  | 0  | 0 | 0  | 0 | 0  | 0  | 0  | 0  | 1  | 0 | 0 | 0   |
| 7  | 6  | 0 | 0  | 0  | 0  | 0  | 0 | 4  | 0  | 0  | 0 | 0  | 0 | 0  | 0  | 0  | 0  | 43 | 0 | 0 | 0   |
| 8  | 0  | 0 | 0  | 7  | 0  | 0  | 0 | 0  | 40 | 0  | 0 | 2  | 0 | 0  | 3  | 0  | 1  | 0  | 0 | 0 | 0   |
| 9  | 0  | 0 | 0  | 0  | 0  | 0  | 0 | 37 | 0  | 0  | 15| 0  | 0 | 0  | 0  | 0  | 0  | 1  | 0 | 0 | 0   |
| 10 | 49 | 0 | 0  | 0  | 0  | 0  | 0 | 0  | 0  | 0  | 0 | 0  | 0 | 0  | 0  | 0  | 3  | 1  | 0 | 0 | 0   |
| 11 | 3  | 0 | 1  | 0  | 0  | 42 | 0 | 0  | 0  | 0  | 0 | 0  | 0 | 0  | 0  | 7  | 0  | 0  | 0 | 0 | 0   |
| 12 | 0  | 0 | 0  | 0  | 0  | 0  | 0 | 0  | 1  | 0  | 0 | 49 | 0 | 0  | 0  | 0  | 0  | 0  | 0 | 0 | 3   |
| 13 | 1  | 0 | 3  | 0  | 0  | 12 | 0 | 13 | 1  | 0  | 0 | 8  | 0 | 0  | 1  | 6  | 3  | 0  | 0 | 0 | 5   |
| 14 | 0  | 0 | 0  | 0  | 0  | 53 | 0 | 0  | 0  | 0  | 0 | 0  | 0 | 0  | 0  | 0  | 0  | 0  | 0 | 0 | 0   |
| 15 | 0  | 0 | 0  | 0  | 0  | 52 | 0 | 0  | 0  | 0  | 0 | 0  | 0 | 0  | 0  | 1  | 0  | 0  | 0 | 0 | 0   |
| 16 | 51 | 0 | 0  | 0  | 0  | 0  | 0 | 0  | 0  | 0  | 0 | 0  | 0 | 0  | 0  | 0  | 2  | 0  | 0 | 0 | 0   |
| 17 | 0  | 0 | 0  | 0  | 0  | 0  | 0 | 0  | 0  | 0  | 0 | 0  | 0 | 52 | 1  | 0  | 0  | 0  | 0 | 0 | 0   |
| 18 | 52 | 0 | 0  | 0  | 0  | 0  | 0 | 0  | 0  | 0  | 0 | 0  | 0 | 0  | 0  | 0  | 1  | 0  | 0 | 0 | 0   |
| 19 | 0  | 0 | 0  | 0  | 0  | 0  | 0 | 0  | 0  | 53 | 0 | 0  | 0 | 0  | 0  | 0  | 0  | 0  | 0 | 0 | 0   |
| 20 | 0  | 0 | 0  | 1  | 0  | 0  | 7 | 0  | 15 | 0  | 0 | 0  | 0 | 26 | 0  | 0  | 0  | 0  | 0 | 4 | 0   |
| 21 | 40 | 0 | 0  | 0  | 0  | 0  | 0 | 0  | 0  | 0  | 1 | 0  | 0 | 0  | 0  | 4  | 8  | 0  | 0 | 0 | 0   |
| 22 | 1  | 0 | 0  | 0  | 0  | 0  | 0 | 1  | 0  | 0  | 0 | 0  | 0 | 0  | 0  | 0  | 0  | 51 | 0 | 0 | 0   |
| 23 | 1  | 0 | 0  | 0  | 3  | 0  | 0 | 3  | 0  | 42 | 0 | 0  | 0 | 0  | 0  | 0  | 0  | 4  | 0 | 0 | 0   |
| 24 | 1  | 0 | 20 | 21 | 0  | 1  | 0 | 0  | 3  | 0  | 3 | 1  | 0 | 0  | 0  | 1  | 0  | 2  | 0 | 0 | 0   |
| 25 | 0  | 0 | 0  | 0  | 0  | 0  | 16| 1  | 0  | 29 | 0 | 0  | 0 | 0  | 0  | 0  | 0  | 5  | 0 | 2 | 0   |
| 26 | 0  | 0 | 0  | 32 | 0  | 20 | 0 | 0  | 1  | 0  | 0 | 0  | 0 | 0  | 0  | 0  | 0  | 0  | 0 | 0 | 0   |
| 27 | 2  | 0 | 0  | 0  | 0  | 0  | 0 | 0  | 0  | 7  | 0 | 0  | 40| 0  | 1  | 3  | 0  | 0  | 0 | 0 | 0   |
| 28 | 17 | 0 | 0  | 0  | 0  | 0  | 0 | 0  | 0  | 0  | 3 | 0  | 0 | 0  | 1  | 0  | 28 | 4  | 0 | 0 | 0   |
| 29 | 0  | 0 | 0  | 0  | 7  | 0  | 0 | 0  | 0  | 46 | 0 | 0  | 0 | 0  | 0  | 0  | 0  | 0  | 0 | 0 | 0   |
| 30 | 0  | 5 | 4  | 0  | 0  | 8  | 2 | 0  | 0  | 0  | 2 | 4  | 0 | 1  | 25 | 0  | 1  | 1  | 0 | 0 | 0   |
| 31 | 0  | 0 | 0  | 33 | 0  | 0  | 0 | 0  | 11 | 0  | 0 | 0  | 0 | 9  | 0  | 0  | 0  | 0  | 0 | 0 | 0   |
| 32 | 3  | 3 | 0  | 0  | 0  | 0  | 3 | 0  | 0  | 0  | 0 | 0  | 0 | 0  | 42 | 2  | 0  | 0  | 0 | 0 | 0   |
| 33 | 0  | 0 | 3  | 0  | 0  | 50 | 0 | 0  | 0  | 0  | 0 | 0  | 0 | 0  | 0  | 0  | 0  | 0  | 0 | 0 | 0   |

Fig. 4

CLUSTAL 2.1 multiple sequence alignment

```
JCVI_A
ECG96325_2   LQPKD IVSIA SHGGA TQAIT TLLNR WGDLR AKE   (SEQ ID NO.78)
ECG96326_7   LDPKD IVSIA SHGGA TQAIT TLLNR WGDLI DLE   (SEQ ID NO.89)
ECG96325_4   LEPKD IVSIA SHIGA NQTIT TLLNK WGALI DLE   (SEQ ID NO.80)
ECG96326_3   LEPKD IVSIA SHIGA NQTIT TLLNK WGALI DLE   (SEQ ID NO.85)
ECG96326_8   LEPKD IVSIA SHKGA NQVIT TLLEK WDDLI SQA   (SEQ ID NO.90)
ECG96325_1   LEPKD IVSIA SNNGA TQAIA TLLAK WDSLI AKG   (SEQ ID NO.77)
ECG96326_6   LESKD IVSIA SNNGA TQTIT RLLEK WDELR AKG   (SEQ ID NO.88)
ECG96326_2   LEPKD IVSIA SHDGS NQTIT KLLEK WDELR AKG   (SEQ ID NO.84)
ECG96326_5   LDPKD IVSIA SHDGS NQTIT KLLEK WDELR AKE   (SEQ ID NO.87)
ECG96325_3   LEPKD IVSIA SHDGA TQAIT TLLEK WDELR AKG   (SEQ ID NO.79)
ECG96326_4   LEPKD IVSIA SHIGA TQAIT TLLNK WAALR AKG   (SEQ ID NO.86)
ECG96325_5   LEPKD IVSIA SHGGA NKAIT TLLEK WAALR AKE   (SEQ ID NO.81)
ECG96326_1   LEPKD IVSIA SNTGA NKTIT RLLEK WGDLR AKE   (SEQ ID NO.83)

ECR81667
ECR81667_1   LKPED IVTIA SHHGG SQAIT TLLEN WDDLL KLE   (SEQ ID NO.106)
ECR81667_3   LKPED IVSIA SHSGG SQAIT TLLEN WDDLI DQE   (SEQ ID NO.108)
ECR81667_2   LKFED IVSIA SHNGA SQAIT TLLEN WEKLI KKG   (SEQ ID NO.107)

JCVI_B
EBN19409_1   FRTEG IVQMV SHGGG SKNLV AVQAN YAALT GLG   (SEQ ID NO.97)
EBN19409_6   FRTEG IVQMV SHGGG SKNLV AVQAN YAALT GLG   (SEQ ID NO.102)
EBN19409_2   FRTED IVQMV SHDGG SKNLV AVQAN YAALT GLG   (SEQ ID NO.98)
EBN19409_5   FRTED IVQMV SHGGG SKNLE VVQAN YAALT GLG   (SEQ ID NO.101)
EBN19408_2   FSAKD IVQMV SHGGG SKNLE VVQAN YAALT GLG   (SEQ ID NO.92)
EBN19409_4   FRTED IVQMV SNNGG SKNLA AIIDK STALK GLG   (SEQ ID NO.100)
EBN19409_8   FRTED IVQMV SHDGG SKNLA AIIDK STALK GLG   (SEQ ID NO.104)
EBN19409_7   FRTED IVQMV SHDGG SKNLA AMIDK YTALK DLG   (SEQ ID NO.103)
EBN19408_3   FRTED IVQMV SHDGG SKNLA AMIDK STALK DLG   (SEQ ID NO.93)
EBN19408_4   FRTED IVQMV SHDGS SKNLA AMIDK STALK GLG   (SEQ ID NO.94)
EBN19408_1   ITYDD LTRIA ARNGG SKNLV AVQAN YAALT ELG   (SEQ ID NO.91)
             :  .. :. :. :. *. .: :    :   .    *

AvrBS3       LTPEQ VVAIA SHGGG KQALE TVQRL LPVLC       (SEQ ID NO.10)
             QAHG
```

Fig. 5

|    | A  | C | D  | E  | F  | G  | H  | I  | K  | L  | M  | N | P  | Q  | R  | S  | T  | V  | W  | Y | GAP |
|----|----|---|----|----|----|----|----|----|----|----|----|---|----|----|----|----|----|----|----|---|-----|
| 1  | 0  | 0 | 0  | 0  | 10 | 0  | 0  | 1  | 0  | 16 | 0  | 0 | 0  | 0  | 0  | 0  | 0  | 0  | 0  | 0 | 0   |
| 2  | 0  | 0 | 2  | 10 | 0  | 0  | 0  | 0  | 3  | 0  | 0  | 0 | 0  | 1  | 9  | 1  | 1  | 0  | 0  | 0 | 0   |
| 3  | 1  | 0 | 0  | 0  | 1  | 0  | 0  | 0  | 0  | 0  | 0  | 0 | 14 | 0  | 0  | 1  | 9  | 0  | 0  | 1 | 0   |
| 4  | 0  | 0 | 1  | 12 | 0  | 0  | 0  | 0  | 14 | 0  | 0  | 0 | 0  | 0  | 0  | 0  | 0  | 0  | 0  | 0 | 1   |
| 5  | 0  | 0 | 25 | 0  | 0  | 2  | 0  | 0  | 0  | 0  | 0  | 0 | 0  | 0  | 0  | 0  | 0  | 0  | 0  | 0 | 1   |
| 6  | 0  | 0 | 0  | 0  | 0  | 0  | 0  | 26 | 0  | 1  | 0  | 0 | 0  | 0  | 0  | 0  | 0  | 0  | 0  | 0 | 0   |
| 7  | 0  | 0 | 0  | 0  | 0  | 0  | 0  | 0  | 0  | 0  | 0  | 0 | 0  | 0  | 0  | 0  | 1  | 26 | 0  | 0 | 1   |
| 8  | 0  | 0 | 0  | 0  | 0  | 0  | 0  | 0  | 0  | 0  | 0  | 0 | 0  | 10 | 1  | 15 | 1  | 0  | 0  | 0 | 0   |
| 9  | 0  | 0 | 0  | 0  | 0  | 0  | 0  | 17 | 0  | 0  | 0  | 0 | 0  | 0  | 0  | 0  | 0  | 0  | 0  | 0 | 0   |
| 10 | 17 | 0 | 0  | 0  | 0  | 0  | 0  | 0  | 0  | 0  | 10 | 0 | 0  | 0  | 0  | 0  | 0  | 10 | 0  | 0 | 1   |
| 11 | 1  | 0 | 0  | 0  | 0  | 0  | 0  | 0  | 0  | 0  | 0  | 0 | 0  | 0  | 26 | 0  | 0  | 0  | 0  | 0 | 0   |
| 12 | 0  | 0 | 0  | 0  | 0  | 0  | 22 | 0  | 0  | 0  | 0  | 4 | 0  | 0  | 1  | 0  | 0  | 0  | 0  | 0 | 1   |
| 13 | 0  | 0 | 8  | 0  | 0  | 7  | 1  | 3  | 1  | 0  | 0  | 5 | 0  | 0  | 0  | 1  | 1  | 0  | 0  | 0 | 0   |
| 14 | 0  | 0 | 0  | 0  | 0  | 27 | 0  | 0  | 0  | 0  | 0  | 0 | 0  | 0  | 0  | 0  | 0  | 0  | 0  | 0 | 0   |
| 15 | 12 | 0 | 0  | 0  | 0  | 12 | 0  | 0  | 0  | 0  | 0  | 0 | 0  | 0  | 0  | 3  | 0  | 0  | 0  | 0 | 1   |
| 16 | 0  | 0 | 0  | 0  | 0  | 0  | 0  | 0  | 0  | 0  | 0  | 7 | 0  | 0  | 0  | 14 | 6  | 0  | 0  | 0 | 1   |
| 17 | 0  | 0 | 0  | 0  | 0  | 0  | 0  | 0  | 13 | 0  | 0  | 0 | 0  | 14 | 0  | 0  | 0  | 0  | 0  | 0 | 0   |
| 18 | 9  | 0 | 0  | 0  | 0  | 0  | 0  | 0  | 0  | 0  | 0  | 11 | 0 | 0  | 0  | 0  | 6  | 1  | 0  | 0 | 0   |
| 19 | 0  | 0 | 0  | 0  | 0  | 0  | 0  | 16 | 0  | 11 | 0  | 0 | 0  | 0  | 0  | 0  | 0  | 0  | 0  | 0 | 0   |
| 20 | 6  | 0 | 0  | 2  | 0  | 0  | 0  | 0  | 0  | 0  | 0  | 0 | 0  | 0  | 0  | 0  | 15 | 4  | 0  | 0 | 0   |
| 21 | 9  | 0 | 0  | 0  | 0  | 0  | 0  | 0  | 2  | 0  | 0  | 0 | 0  | 0  | 2  | 0  | 12 | 2  | 0  | 0 | 0   |
| 22 | 0  | 0 | 0  | 0  | 0  | 0  | 0  | 2  | 0  | 16 | 3  | 0 | 0  | 0  | 0  | 0  | 0  | 6  | 0  | 0 | 0   |
| 23 | 0  | 0 | 0  | 0  | 0  | 0  | 0  | 5  | 0  | 16 | 0  | 0 | 0  | 6  | 0  | 0  | 0  | 0  | 0  | 0 | 0   |
| 24 | 7  | 0 | 5  | 10 | 0  | 0  | 0  | 0  | 0  | 0  | 0  | 5 | 0  | 0  | 0  | 0  | 0  | 0  | 0  | 0 | 0   |
| 25 | 0  | 0 | 0  | 0  | 0  | 0  | 0  | 0  | 16 | 0  | 0  | 9 | 0  | 0  | 2  | 0  | 0  | 0  | 0  | 0 | 1   |
| 26 | 0  | 0 | 0  | 0  | 0  | 0  | 0  | 0  | 0  | 0  | 0  | 0 | 0  | 0  | 0  | 4  | 0  | 0  | 16 | 7 | 0   |
| 27 | 8  | 0 | 8  | 1  | 0  | 5  | 0  | 0  | 0  | 0  | 0  | 0 | 0  | 0  | 0  | 0  | 5  | 0  | 0  | 0 | 0   |
| 28 | 15 | 0 | 6  | 4  | 0  | 0  | 0  | 0  | 1  | 0  | 0  | 0 | 0  | 0  | 0  | 1  | 0  | 0  | 0  | 0 | 0   |
| 29 | 0  | 0 | 0  | 0  | 0  | 0  | 0  | 0  | 0  | 27 | 0  | 0 | 0  | 0  | 0  | 0  | 0  | 0  | 0  | 0 | 0   |
| 30 | 0  | 0 | 0  | 0  | 0  | 0  | 0  | 7  | 5  | 1  | 0  | 0 | 0  | 0  | 8  | 0  | 6  | 0  | 0  | 0 | 0   |
| 31 | 9  | 0 | 6  | 1  | 0  | 8  | 0  | 0  | 2  | 0  | 0  | 0 | 0  | 0  | 0  | 1  | 0  | 0  | 0  | 0 | 0   |
| 32 | 0  | 0 | 0  | 0  | 0  | 0  | 0  | 0  | 10 | 15 | 0  | 0 | 0  | 2  | 0  | 0  | 0  | 0  | 0  | 0 | 0   |
| 33 | 1  | 0 | 0  | 9  | 0  | 17 | 0  | 0  | 0  | 0  | 0  | 0 | 0  | 0  | 0  | 0  | 0  | 0  | 0  | 0 | 0   |

Fig. 7

| | | | Target A | Target B | Target C |
|---|---|---|---|---|---|
| Nter | MSTAFVDQDKQMANRLN<br>LSPLERSKIEKQY<br>LSRADILKIASYD | GGATTLAFISNKQNELAQI<br>CAAHALQAVLDCGPMLGKRG (SEQ ID NO. 7) | | | |
| Module 1 | FSQSDIVKIAGN | I | GGAQALQAVLDLESMLGKRG (SEQ ID NO. 11) | A | A | A |
| Module 2 | FSRDDIAKMAGN | I | GGAQTLQAVLDLESAFRERG (SEQ ID NO. 12) | A | A | A |
| Module 3 | FSQADIVKIAGN | N | GGAQALYSVLDVEPTLGKRG (SEQ ID NO. 13) | G | G | G |
| Module 4 | FSRADIVKIAGN | T | GGAQALHTVLDLEPALGKRG (SEQ ID NO. 14) | A | T | A |
| Module 5 | FSRIDIVKIAAN | N | GGAQALHAVLDLGPTLRECG (SEQ ID NO. 15) | G | G | G |
| Module 6 | FSQATIAKIAGN | I | GGAQALQMVLDLGPALGKRG (SEQ ID NO. 16) | A | A | A |
| Module 7 | FSQATIAKIAGN | I | GGAQALQTVLDLEPALCERG (SEQ ID NO. 17) | A | A | A |
| Module 8 | FSQATIAKMAGN | N | GGAQALQTVLDLEPALRKRD (SEQ ID NO. 18) | G | G | G |
| Module 9 | FRQADIIKIAGN | D | GGAQALQAVIEHGPTLRQHG (SEQ ID NO. 19) | C | C | C |
| Module 10 | FNLADIVKMAGN | I | GGAQALQAVLDLKPVLDEHG (SEQ ID NO. 20) | A | A | A |
| Module 11 | FSQPDIVKMAGN | I | GGAQALQAVLSLGPALRERG (SEQ ID NO. 21) | A | A | A |
| Module 12 | FSQPDIVKIAGN | T | GGAQALQAVLDLELTIVEHG (SEQ ID NO. 22) | A | T | A |
| Module 13 | FSQPDIVRITGN | R | GGAQALQAVLALELTLRERG (SEQ ID NO. 23) | G | T | T |
| Module 14 | FSQPDIVKIAGN | S | GGAQALQAVLDLELTFRERG (SEQ ID NO. 24) | A | A | A |
| Module 15 | FSQADIVKIAGN | D | GGTQALHAVLDLERMLGERG (SEQ ID NO. 25) | | | |
| Module 16 | FSRADIVNVAGN | N | GGAQALKAVLEHEATLNERG (SEQ ID NO. 26) | G | G | G |
| Module 17 | FSRADIVKIAGN | G | GGAQALKAVLEHEATLDERG (SEQ ID NO. 27) | T | T | T |
| Module 18 | FSRADIVRIAGN | G | GGAQALKAVLEHGPTLNERG (SEQ ID NO. 28) | T | T | T |
| Module 19 | FNLTDIVEMAAN | S | GGAQALKAVLEHGPTLRQRG (SEQ ID NO. 29) | A | A | A |
| Module 20 | LSLIDIVELASN | * | GGAQALKAVLKYGPVLMQAG (SEQ ID NO. 30) | G | G | G |
| Cter | RSNEEIVHVAARRGGAGRIRKMVAPLLERQ (SEQ ID NO. 64) | | | | | |

Fig. 8

```
D4:    aacccc attgtccgggaacccagagctcacag----gatcttagacccgagcccacagag
       ||||||||||||||||||||||||||||||||    ||||||||||||||||||||||||
WT:    aacccc attgtccgggaacccagagctcacagccacgatcttagacccgagcccacagag D3:    aacccc attgtccgggaacccagagctcacag---cgatcttagacccgagcccacagag
       |||||||||||||||||||||||||||||||||   ||||||||||||||||||||||||
WT:    aacccc attgtccgggaacccagagctcacagccacgatcttagacccgagcccacagag D5:    gaacccc attgtccgggaacccagagctcac-----cgatcttagacccgagcccacaga
       |||||||||||||||||||||||||||||||      |||||||||||||||||||||||
WT:    gaacccc attgtccgggaacccagagctcacagccacgatcttagacccgagcccacaga D26:   aacccc attgtccgggaacccagagct----------------------cacagag
       |||||||||||||||||||||||||||                       |||||||
WT:    aacccc attgtccgggaacccagagctcacagccacgatcttagacccgagcccacagag D28:   aacccc attgtccgggaacccagagctcac------------------------ag
       |||||||||||||||||||||||||||||||                        ||
WT:    aacccc attgtccgggaacccagagctcacagccacgatcttagacccgagcccacagag D26b:  aacccc attgtccgggaaccca--------------------------gagcccacagag
       ||||||||||||||||||||||                          ||||||||||||
WT:    aacccc attgtccgggaacccagagctcacagccacgatcttagacccgagcccacagag +6:    aacccc attgtccgggaacccagagctcacagaaaaacggacgatcttagacccgagcccacagag
       ||||||||||||||||||||||||||||||||||||||      ||||||||||||||||||||||
WT:    aacccc attgtccgggaacccagagctcacag------ccacgatcttagacccgagcccacagag +5:    aacccc attgtccgggaacccagagctcacagccacgccacgatcttagacccgagcccaacagag
       |||||||||||||||||||||||||||||||||||      |||||||||||||||||||||||||
WT:    aacccc attgtccgggaacccagagctcaca-----gccacgatcttagacccgagcccaacagag +3:    aacccc attgtccgggaacccagagctcacagccaccacgatcttagacccgagcccacagag
       ||||||||||||||||||||||||||||||||||   |||||||||||||||||||||||||
WT:    aacccc attgtccgggaacccagagctcacag---ccacgatcttagacccgagcccacagag
```

Fig. 10

WT:  aaccccattgtccgggaacccagagctcacagccacgatcttagacccgagcccacagagccagaggtg

Δ5:  aaccccattgtccgggaacccagagctcaca------gatcttagacccgagcccacagagccagaggtg (x10)
Δ4a: aaccccattgtccgggaacccagagctcacagc-----atcttagacccgagcccacagagccagaggtg (x9)
Δ4b: aaccccattgtccgggaacccagagctcacagcc----tcttagacccgagcccacagagccagaggtg (x9)
Δ26: aaccccattgtccgggaacccagagct------------------------cacagagccagaggtg (x6)
Δ3:  aaccccattgtccgggaacccagagctcacag---cgatcttagacccgagcccacagagccagaggtg (x6)

Fig. 11

```
WT:    aaccccattgtccgggaacccagagctcacagcccacgatcttagacccgagcccacagagccagaggtg Δ4:    aaccccattgtccgggaacccagagctcacagc----atcttagacccgagcccacagagccagaggtg  (x12)
Δ5:    aaccccattgtccgggaacccagagctcaca------gatcttagacccgagcccacagagccagaggtg (x10)
Δ3a:   aaccccattgtccgggaacccagagctcacag---cgatcttagacccgagcccacagagccagaggtg  (x8)
Δ26:   aaccccattgtccgggaacccagagct-------------cacagagccagaggtg               (x7)
Δ3b:   aaccccattgtccgggaacccagagctcacagcc---atcttagacccgagcccacagagccagaggtg  (x7)
```

Fig. 12

```
Nter BurrH_36  (SEQ ID NO. 548)  STAFVDQDKQ MANRLNLSPL ERSKIEKQYG GATTLAFISN KQNELAQI-L
pCLS21512      (SEQ ID NO. 549)  STAFVDQDKQ MANRLNLSPL ERSKIEKQNG GATTLAFISN KQNELAQI-L
pCLS21513      (SEQ ID NO. 550)  STAFVDQDKQ MANRLNLSPL ERSKIEKQWS GARTLAFISN KQNELAQIGL
pCLS21514      (SEQ ID NO. 551)  STAFVDQDKQ MANRLNLSPL ERSKIEKQYG GATTLAFISN KQNELAQI-L
pCLS21515      (SEQ ID NO. 552)  STAFVDQDKQ MANRLNLSPL ERSKIEKQYG GATTLAFISN KQNELAQI-L
pCLS21516      (SEQ ID NO. 553)  STAFVDQDKQ MANRLNLSPL ERSKIEKQWG GATTLAFISN KQNELAQI-L
pCLS21517      (SEQ ID NO. 554)  STAFVDQDKQ MANRLNLSPL ERSKIEKQWS GATTLAFISN KQNELAQI-L
pCLS21518      (SEQ ID NO. 555)  STAFVDQDKQ MANRLNLSPL ERSKIEKQTG GATTLAFISN KQNELAQIGL
pCLS21519      (SEQ ID NO. 556)  STAFVDQDKQ MANRLNLSPL ERSKIEKQRG GATTLAFISN KQNELAQI-L
pCLS21520      (SEQ ID NO. 557)  STAFVDQDKQ MANRLNLSPL ERSKIEKQYG GATTLAFISN KQNELAQIGF Nter BurrH_36  (SEQ ID NO. 548)  SRADILKIAS YDCAAHALQA VLDCGPMLGK RG..........
pCLS21512      (SEQ ID NO. 549)  SRADILKIAS QGCAAHALQA VLDCGPMLGK RG..........
pCLS21513      (SEQ ID NO. 550)  SRADILKIAS KRGGAHALQA VLDCGPMLGK RG..........
pCLS21514      (SEQ ID NO. 551)  SRADILKIAS YDCAAHALQA VLDCGPMLGK RGLSQADIVK IASNGGGAQA
pCLS21515      (SEQ ID NO. 552)  SRADILKIAG NGGGAHALQA VLDCGPMLGK RG..........
pCLS21516      (SEQ ID NO. 553)  SRADILKIAG NGGGAHALQA VLDCGPMLGK RG..........
pCLS21517      (SEQ ID NO. 554)  SRADILKIAG KRCAAHALQA VLDCGPMLGK RG..........
pCLS21518      (SEQ ID NO. 555)  SRADILKIAS YGCAAHALQA VLDCGPMLGK RG..........
pCLS21519      (SEQ ID NO. 556)  SRADILKIAK RGGAAHALQA VLDCGPMLGK RG..........
pCLS21520      (SEQ ID NO. 557)  SQADILKIAG NGGGAHALQA VLDCGPTLGK RG..........

Nter BurrH_36  (SEQ ID NO. 548)  ..........
pCLS21512      (SEQ ID NO. 549)  ..........
pCLS21513      (SEQ ID NO. 550)  ..........
pCLS21514      (SEQ ID NO. 551)  LKAVLDCGPM LGERG
pCLS21515      (SEQ ID NO. 552)  ..........
pCLS21516      (SEQ ID NO. 553)  ..........
pCLS21517      (SEQ ID NO. 554)  ..........
pCLS21518      (SEQ ID NO. 555)  ..........
pCLS21519      (SEQ ID NO. 556)  ..........
pCLS21520      (SEQ ID NO. 557)  ..........
```

Fig. 16A

```
Nter BurrH_36(Δ26)  (SEQ ID NO. 559)  .................  .................  ADLRTLGYSQ QQQEKIKPKV RSTVAQHHEA LVGHGFTHAH IVALSQHPAA
pCLS21521           (SEQ ID NO. 558)  .................  .................  .................  .................  .................

Nter BurrH_36(Δ26)  (SEQ ID NO. 559)  .................  KQY GGATTLAFIS NKQNELAQIL
pCLS21521           (SEQ ID NO. 558)  LGTVAVKYQD MIAALPEATH EAIVGVGKQW SGARTLAFIS NKQNELAQIL Nter BurrH_36(Δ26)  (SEQ ID NO. 559)  SRADILKIAS YDCAAHALQA VLDCGPMLGK RG
pCLS21521           (SEQ ID NO. 558)  SRADILKIAS KRGGAHALQA VLDCGPMLGK RG
```

Fig. 16B

MODULAR BASE-SPECIFIC NUCLEIC ACID BINDING DOMAINS FROM BURKHOLDERIA RHIZOXINICA PROTEINS

CROSS-REFERENCE TO RELATED APPLICATIONS

This application is a continuation of US patent application Ser. No. 13/949,880 filed Jul. 24, 2013, which claims priority under 35 U.S.C. 119(e) to U.S. Provisional Application No. 61/675,160, filed Jul. 24, 2012 and to U.S. Provisional Application No. 61/759,744, filed Feb. 1, 2013, which are hereby incorporated by reference in their entireties.

FIELD OF THE INVENTION

The present invention concerns the field of genetic engineering and the reprogramming of cells functions using protein fusions involving new modular specific nucleic acid binding domains.

These modular nucleic acid binding domains result from the rearrangement of genomic sequences coming from *Burkholderia rhizoxinica*, a bacterial endosymbiont of the fungus *Rhizopus microsporus*.

Fusion proteins of these new engineered binding domains with catalytic domains of different nucleic acid processing enzymes, in particular catalytic domains having endonuclease activity, permit the processing of genomes at desired targeted loci.

BACKGROUND OF THE INVENTION

Significant progress has been made over the last years in the way genomes can be investigated and modified in living cells. The main challenge in this matter is to transfect the living cells with enzyme molecules that are able to process targeted genetic sequences in a sequence specific manner, without inducing toxicity. This goal has been reached using enzymes derived from natural proteins, for instance by creating variants of homing endonucleases, also called meganucleases (Stoddard, Monnat et al. 2007; Arnould, Delenda et al. 2011), but also by creating fusion proteins, such as for instance the fusion of TALE DNA binding domain with a catalytic domain (Christian, Cermak et al. 2010; Li, Huang et al. 2011)

Transcription Activator Like Effectors (TALE) has been widely used for several applications in the field of genome engineering. The sequence specificity, of this family of proteins used in the infection process by plant pathogens of the *Xanthomonas* genus, is driven by an array of motifs of 33 to 35 amino acids repeats, differing essentially by the two positions 12 and 13 (Boch, Scholze et al. 2009; Moscou and Bogdanove 2009). The recent achievement of the high resolution structure of TAL effectors bound to DNA showed that each single base of the same strand in the DNA target is contacted by a single repeat (Deng, Yan et al. 2012; Mak, Bradley et al. 2012), with the specificity resulting from the two polymorphic amino acids of the repeat; the so-called RVDs (repeat variable dipeptides). The modularity of these DNA binding domains has been confirmed by assembly of repeats designing TALE-derived protein with new sequence specificities.

TALE proteins has so far been described as containing: (i) an N-terminal domain including a translocation signal, (ii) a central DNA-binding domain, and (iii) a C-terminal domain including a nuclear localization signal (NLS) and an acidic activation domain (AD). A representative member of this family is AvrBs3 from *Xanthomonas vesicatoria* (SWIS-SPROT P14727) that has a 1164 amino acid sequence comprising a N-terminal domain of 288 amino acids (position 1 to 288), a central domain of 593 amino acids (positions 289 to 881), and a C-terminal domain of 283 amino acids (positions 882 to 1164) comprising a NLS and AD (transcription activation domain). The DNA-binding domain which determines the target specificity of each TALE consists of a variable number (generally 12 to 27) of tandem, nearly identical, 33-35 amino acid repeats, followed by a single truncated repeat. For example, AvrBs3 DNA-binding domain (SEQ ID NO. 1) comprises 17 repeats of 34 amino acids and a truncated repeat of 15 amino acids. The "repeat-variable di-residue" (RVD), which represents the variable residues in the repeat determines the specificity of interaction with the nucleotide base of the DNA target, in a code-like fashion with some degeneracy. The four most common RVDs are HD with respect to c, NI with respect to a, NG with respect to t and NN with respect to g ((Boch, Scholze et al. 2009; Moscou and Bogdanove 2009; Bogdanove and Voytas 2011), WO 2011/072246).

This straightforward sequence relationship between RVDs and nucleotide bases allows the production of custom TAL effectors that bind DNA sequences of interest by assembling an array of repeats that corresponds to the intended target site. Such engineered TALE proteins have improved gene-editing technology (Baker 2012). A variety of rapid construction methods for custom TALE fusion proteins have recently been developed based on the protein scaffold of AvrBs3-like proteins by adding catalytic protein domains to the C-terminal. (US 2011/0145940; Cermak, Doyle et al. 2010; Weber, Gruetzner et al. 2011; Zhang, Cong et al. 2011; Doyle, Booher et al. 2012). TAL effectors have been, for instance fused to a nuclease catalytic head to form specific nucleases (TALE-Nuclease) creating thereby new tools, especially for genome engineering applications, that have proven efficiency in cell-based assays in yeast, mammalian cells and plants (Cermak, Doyle et al. 2010; Christian, Cermak et al. 2010; Geissler, Scholze et al. 2011; Huang, Xiao et al. 2011; Li, Huang et al. 2011; Mahfouz, Li et al. 2011; Miller, Tan et al. 2011; Morbitzer, Elsaesser et al. 2011; Mussolino, Morbitzer et al. 2011; Sander, Cade et al. 2011; Tesson, Usal et al. 2011; Weber, Gruetzner et al. 2011; Zhang, Cong et al. 2011; Li, Piatek et al. 2012; Mahfouz, Li et al. 2012).

Meanwhile, the Transcription Activator Like Effectors so far described in the literature (AvrXa7, Hax, PthXo1, . . . ) are highly similar to the protein AvrBs3 and all originate from *Xanthomonas* or its closely related *Ralstonia* bacterial genus.

One of the drawbacks of the Transcription Activator Like Effectors from *Xanthomonas* lies in the fact that they mostly consists of highly repetitive motifs, nearly identical to each other. The high identity of these repeats is prompted to create genetic recombination or instability when the repeats are assembled to form engineered nucleic acid binding domains.

A first level of difficulty occurs at the polynucleotide level to clone the repeat sequences due to the fact that restriction sites and PCR primers are basically the same for each repeat. Under these conditions, it gets difficult to perform routine lab procedures to check that the repeats have been cloned properly, in the good number and in the right order. This is although essential to achieve proper expression of a DNA binding protein that is expected to show specificity with a desired nucleic acid sequence.

A second level of difficulty occurs when the polynucleotide sequences are included in vectors for heterologous expression, in particular when using viral vectors. As recently reported by Holkers et al. (2012), it appears that DNA tandem repeat motifs from TALE scaffold are generally incompatible with lentiviral vector system due to some internal sequence recombinations. This particularly limits the current use of TALE proteins into primary cells, which are generally not permissive towards classical gene transfer technologies.

Lower efficiencies of TALE derived proteins have also been reported in certain cell types, like for instance in mice, or in relation with epigenetic modifications, so that alternative or complementary solutions to improve TALE derived protein are still actively sought.

Unexpectedly, the present inventors have identified putative proteins from the bacterial endosymbiont *Burkholderia rhizoxinica* and others from a marine organism, displaying highly polymorphic modules having specific DNA binding activity, while having very different sequence (less than 40% identity) in comparison with TALE repeats. These proteins have also completely different N and C terminal domains. The modules found in these proteins have higher sequence variability than TALE repeats and can although be assembled to engineer new base per base specific binding domains (MBBBD) to target nucleic acid sequences in genomes. These modules confer better sequence stability when they are assembled and expressed in living cells as nucleic acid binding domains.

SUMMARY OF THE INVENTION

The present invention concerns new modular base-per-base specific nucleic acid binding domains (MBBBD) derived from newly identified proteins from the bacterial endosymbiont *Burkholderia Rhizoxinica*, namely EAV36_BURRH, E5AW43_BURRH, E5AW45_BURRH and E5AW46_BURRH proteins and from other similar proteins identified from marine organisms metagenomic database referred to as JCVI_A and JCVI_B and ECR81667.

These proteins comprise modules of about 31 to 33 amino acids that, when assembled together, form modular base-per-base binding domains (MBBBD). A Parallel may be made with the repeat domains of TALE proteins from *Xanthomonas*. However the modules in these binding domains display less than 40% sequence identity with TALE common repeats and much more sequence variability. In addition, most modules from these proteins display amino acid variability only in position 13, and not in position 12, whereas variability is observed both in positions 12 and 13 in the variable di-residues (RVDs) of TALE proteins. As a result, into the engineered MBBBDs according to the invention, base specificity may rely only on position 13 of the modules by merely following a one base/one amino acid code. These proteins display also different N and C-terminal domains, which are much shorter than in TALE proteins.

The different domains from said proteins (modules, N and C terminals) are useful to engineer new proteins or scaffolds having binding properties to specific nucleic acid sequences. Assembling the different modules into new MBBBDs allows targeting almost any nucleic acid sequence in a genome. The MBBBDs can thereby be fused to different catalytic domains to process DNA at the locus of a target nucleic acid sequence, especially nuclease and transcriptional activators. In particular, new rare-cutting endonucleases can be derived from these polypeptides with improved specificity or cleavage activity towards a specific locus. The invention also provides chimeric proteins resulting from the assembly of the different domains from said new modular proteins with functional domains of TALE-like proteins.

The inventors have conceived different fusion or hybrid proteins deriving from the above polypeptides and polynucleotides and methods to use same.

E5AV36_BURRH E5AW43, E5AW45 JCVI_A, JCVI_B and/or ECR81667 modules can be assembled to form modular base-per-base binding domains (MBBBD). By modular base-per-base binding domains is meant a succession of polypeptide modules assembled in order to respectively target a nucleic acid base in a given nucleic acid target sequence.

Such MBBBD can be fused to catalytic domains in order to process DNA at a locus defined by a nucleic acid target sequence, especially to a transcription activator, such as VP16 or VP64 or to some repression factors such as for example KRAB (kruppel-associated box) domain.

The MBBBD of the invention can be more particularly fused to a nuclease catalytic head, especially catalytic domains from Fok-I, to form specific endonucleases, which allow dimerization of Fok-1. The MBBBDs have several advantages over TALE-repeats. In particular, the fact that the modules can display non repeated sequences provides the MBBBDs with improved modularity. MBBBD are likely to be processed more easily using PCR, cloning methods and viral delivery methods because polynucleotide sequences encoding the modules are not identical to each other. As a further advantage, MBBBDs allow fusions with further nuclease domains such as I-TevI, making them active under monomeric form as well.

The resulting fusion proteins therefore form a new class of engineered endonucleases useful for gene targeting and edition of genomes.

Hybrid TALE-like proteins can be also created by combining polypeptide domains (modules, N or C terminals) from the above E5AV36, E5AW43, E5AW45, E5AW46, JCVI_A, JCVI_B and ECR81667 proteins with those of currently existing, natural or engineered TALEs of AvrBs3-like proteins. Such new chimeric TALE-like proteins can be assembled using the methods already well-established in the art for engineering TALE domains, in particular by subcloning the sequences encoding modules or repeats in polynucleotide vectors, for instance, by using Golden Gate cloning method. Preferably, the protein domains from the E5AV36, E5AW43, E5AW45, E5AW46, JCVI_A, JCVI_B and ECR81667 proteins (module domain, N-terminal domain, C-terminal domain) will be used in combination with the complementary domains of classical TAL effectors.

Fusions of catalytic domains to the BURRH polypeptides according to the invention may be N-terminal or C-terminal fusions, with any appropriate linkers or truncations.

E5AV36_BURRH E5AW43, E5AW45 JCVI_A, JCVI_B and/or ECR81667 modules can also be used as template to build new artificial repeats for TALE-like proteins. Such artificial repeat arrays can be created by introducing mutations into their sequences or by introducing new RVDs into repeats or modules. Key positions at the N/C-terminal domains of the protein can be partially or totally degenerated to modulate DNA affinity as well as interactions with other cofactors. An extensive screening may be also carried out to identify new modules and new RVD-like structures throughout the genomes diversity.

DISCLOSURE OF THE INVENTION

1/BURRH Polypeptides Displaying Modular Base-specific Binding Domains

Upon an extensive search for proteins that may display DNA binding properties throughout a selection of genomes, the present inventors have unexpectedly identified 4 proteins from the microorganism *Burkholderia rhizoxinica* displaying a modular structure. These modules share a low identity with TALE proteins and have completely different N and C-terminals. Interestingly, the modules of these proteins display more variability than AvrBs3-like repeats and their amino acids in position 12 and 13 significantly differ from those at play in *Xanthomonas*.

*Burkholderia rhizoxinica* is an intracellular symbiont of the phytopathogenic zygomycete *Rhizopus microsporus*, the causative agent of rice seedling blight. The endosymbiont produces the antimitotic macrolide rhizoxin for its host. It is vertically transmitted within vegetative spores and is essential for spore formation of the fungus. Its 3.75 Mb genome, which consists of a chromosome and two strain-specific plasmids, was recently sequenced by Lackner, Moebius et al. 2011. Unlike TALE proteins, the DNA binding protein derived from *Burkholderia rhizoxinica* do not display a transactivator domain and very few is known about the biology of this microorganism.

In a general aspect, the present invention relates to the discovery and identification of new modular proteins obtainable from the different domains of these four proteins:

EAV36_BURRH (SEQ ID NO.2);

E5AW43_BURRH (SEQ ID NO.3);

E5AW45_BURRH (SEQ ID NO.4), and

E5AW46_BURRH (SEQ ID NO.5),

The modular arrays of EAV36_BURRH, E5AW43_BURRH and E5AW45_BURRH proteins are flanked by short C and N terminal domains, which do not appear to contain either an acidic domain or a NLS.

The alignment of the proteins sequences E5AV36, E5AW43, E5AW45, E5AW46 (SEQ ID NO. 2 to SEQ ID NO. 5) from BURRH and of AvrBs3 (SEQ ID NO.1) are presented in FIG. 1.

EAV36_BURRH appears to contain 20 modules and a shorter N- and C-termini.

E5AW45_BURRH numbers 27 modules and has N- and C-termini very similar to EAV36_BURRH.

E5AW43_BURRH and E5AW46_BURRH are much shorter polypeptides.

E5AW43_BURRH has only 6 modules, whereas E5AW46_BURRH does not appear to have any. However, the N- and C-termini of E5AW43_BURRH and E5AW46_BURRH are very similar to EAV36_BURRH.

EAV36_BURRH, E5AW43_BURRH and E5AW45_BURRH proteins are currently annotated in Cog database [http://www.ncbi.nlm.nih.gov/COG] as being: "AraC-type DNA-binding domain-containing proteins". Thus, in one aspect, the invention relates to the use of these proteins, and more generally of AraC-type DNA binding domains, and more especially modules thereof, for engineering fusion proteins having modular base per base sequence specific binding domains.

The alignments of the modules and of the -N and -C terminal sequences of the above BURRH proteins are presented in Table 23 and 24 as follows:

Aligned N-ter sequences (Table 23):

| 1) AvrBs3 N-ter | (SEQ ID NO.6) | 287 AA |
|---|---|---|
| 2) E5AV36_BURRH N-ter | (SEQ ID NO.7) | 82 AA |
| 3) E5AW45_BURRH N-ter | (SEQ ID NO.9) | 83 AA |
| 4) E5AW43_BURRH N-ter | (SEQ ID NO.8) | 83 AA |

Aligned C-ter sequences (Table 24):

| 1) E5AW43_BURRH C-ter | (SEQ ID NO.65) | 30 AA |
|---|---|---|
| 2) E5AW45_BURRH C-ter | (SEQ ID NO.66) | 30 AA |
| 3) E5AV36_BURRH C-ter | (SEQ ID NO.64) | 30 AA |
| 4) AvRBS3 C-ter | (SEQ ID NO.111) | 231 AA |

The alignments have been made using standard alignment software using a segment to segment approach (Burkhard Morgenstern (1999). DIALIGN 2: improvement of the segment-to-segment approach to multiple sequence alignment. *Bioinformatics* 15, 211-218).

The different module sequences are listed in Table 27 and aligned in FIG. 2.

By contrast with what has been already published for classical TAL effectors repeats these modules show a higher degree of polymorphism. Nevertheless, as shown in logotype and occurrence matrix in FIGS. 3 and 4, it is interesting to observe that a stretch of 15 amino acids, from position 5 to 19 represented below, is highly conserved among the different modules:

$$D \ I \ V \ K \ I \ A \ G \ X_1 \ X_2 \ G \ G \ A \ Q \ A \ L,$$

where $X_1$ in position 12 is mostly represented by N, but can also be represented in some instances by K, and where $X_2$ in position 13 varies between different amino acids, more particularly: G, I, N, S, D, T, A, K and R.

The amino acids $X_1$ and $X_2$ found in positions 12 and 13 of these modules are more particularly: NI, ND, NG, NA, **, NT, NS, NR, NK, KG and N* (where * means that a deletion appears in the alignment made of the different module sequences as shown in Table 27). Position 12 is mainly represented by N, whereas position 13 is more variable, which suggests that the specificity with respect to nucleobases could rely more particularly on position 13. In such an event, NT, **, KG, and NR appear to be additional di-residues not occurring in *Xanthomonas* TALE proteins.

Interestingly, the data presented in the present application, in particular with respect to E5AV36_BURRH target specificity (see FIG. 8) suggests that the nucleotide base specificity could even be determined only by $X_2$ (position 13) of each module, position 12 ($X_1$) being preferably N, thereby defining a one amino-acid/base code recognition. This would form the first code ever linking one amino acid to one base for specific recognition. This code appears to be primarily based on the following correspondences (AA: amino acid preferably in position 13 of the module):

Primary Code

| AA | Nucleotide base |
|---|---|
| I | A |
| G | T |
| D | C |
| N | G |

Possible alternative recognition also appears between the following amino acids and nucleotide bases as follows:

Secondary Code

| AA | Nucleotide base |
|---|---|
| S, T | A |
| R | T |
| T, * | C |
| R | G |

The symbol "*" (star) means a gap i.e. that there is no position aligned with position 13 using clustal alignment of the different modules.

It is also interesting to observe that most modules start with F and generally with FS, and end with G, generally RG.

Some modules from the above proteins also comprise less than 33 amino acids.

When considering amino acids that are present in more than 50% of the modules, the following consensus sequence can be drawn:

F S - - D I V K I A G N - G G A Q A

L - A V L - - - P T L - - R G where the symbol "-" means a standard amino acid which is more variable.

The above consensus sequences are fully distinct from that of AvrBs3 repeats.

The matrix in Table 28 details the percentages of identity found between each of the different modules of the BURRH proteins and the following representative AvrBs3 repeat sequence:

```
                                          (SEQ ID NO. 10)
AvrBs3    LTPEQVVAIASXXGGGKQALETVQRLLPVLCQAHG
```

The percentages of sequence identities for the different modules with respect to the above AvrBs3 repeat are indicated in bold in this matrix. The identity is comprised between 23% (E5AV36_2) and 47% (E5AW45_24 and E5AW45_27).

Polynucleotide sequences encoding the BURRH proteins E5AV36, E5AW43, E5AW45 and E5AW46 are also part of the invention. They are respectively referred to as SEQ ID NO.113 (E5AV36), SEQ ID NO.114 (E5AW43), SEQ ID NO.112 (E5AW45) and SEQ ID NO.115 (E5AW46).

2/Metagenomic Polypeptides with Similarity to the BURRH Polypeptides

Further search in genome databases were performed to identify further proteins having sequence similarity with the above BURRH proteins.

This search has permitted to identify the following polynucleotide sequence of so far unreported function encoded by genomic DNA isolated from marine organism sample.

The exact organism from which these metagenomic DNA sequences have been extracted has not been yet established. The DNA sequences might comprise some uncertainties due to the sequencing method. Thus, as a preliminary step, the inventors have reconstructed the original polynucleotide sequences (SEQ ID NO. 67 to SEQ ID NO. 70) to obtain the following full length protein sequences:

JCVI_A (SEQ ID NO.72) (Table 29);
JCVI_B (SEQ ID NO.73) (Table 30); and
ECR81667 (SEQ ID NO.71) (Table 31).

Initially, the primary polypeptide sequences were derived from polynucleotide sequences from different open reading frames that had to be assembled: JCVI_ORF_1096675837214 (SEQ ID NO.116), JCVI_ORF_1096688227496 (SEQ ID NO.117), JCVI_ORF_1096688227494 (SEQ ID NO.118), JCVI_ORF_1096675837216 (SEQ ID NO.119) and JCVI_ORF_1096688327480 (SEQ ID NO.120), data extracted from http://www.ncbi.nlm.nih.gov/Taxonomy/Browser/wwwtax.cgi?Ivl=0&id=408172.

The N-terminal and C-terminal of these proteins have been aligned with those from the BURRH proteins:

Aligned N-ter sequences of the following sequences are presented in Table 32:

| | | |
|---|---|---|
| 1) JCVI_B N-ter | (SEQ ID NO.75) | 76 AA |
| 2) JCVI_A N-ter | (SEQ ID NO.74) | 66 AA |
| 3) AvrBs3 N-ter | (SEQ ID NO.6) | 287 AA |
| 4) E5AV36_BURRH N-ter | (SEQ ID NO.7) | 82 AA |
| 5) E5AW45_BURRH N-ter | (SEQ ID NO.9) | 83 AA |
| 6) E5AW43_BURRH N-ter | (SEQ ID NO.8) | 83 AA |

Aligned C-ter sequences of the following sequences are presented in Table 33:

| | | |
|---|---|---|
| 1) EAW43_BURRH C-ter | (SEQ ID NO.65) | 30 AA |
| 2) E5AW45_BURRH C-ter | (SEQ ID NO.66) | 30 AA |
| 3) E5AV36_BURRH C-ter | (SEQ ID NO.64) | 30 AA |
| 4) AvRBS3 C-ter | (SEQ ID NO.111) | 231 AA |
| 5) JVCI_A C-ter | (SEQ ID NO.110) | 24 AA |
| 6) ECR81667 C-ter | (SEQ ID NO.109) | 24 AA |

It can be observed from the above alignments a significant variability between the C- and N-terminal domains from BURRH and the metagenomic proteins, which are also much shorter than those from AvrBs3.

The module polypeptides of 33 amino acids from the three metagenomic proteins have been aligned using Clustal multiple alignment (FIG. 5). These modules also display a higher degree of polymorphism than what can be found among *Xanthomonas* TALEs. It is although interesting to observe from the logotype and occurrence matrix of FIGS. 6 and 7, that a stretch of 10 amino acids, from position 5 to 14, is highly conserved:

D I V S I A S $\underline{X'_1}$ $\underline{X'_2}$ G, where $X'_1$ in position 12 is mostly represented by H, but can also be represented by N or R, and where $X'_2$ in position 13 varies between different amino acids, more particularly: D, G, N, I, H, K S and T.

It is also noteworthy that most modules start with L or F and generally finish with G or E.

Amino acids $X'_1$ and $X'_2$ found in positions 12 and 13 of these modules are more particularly: HI, HD, HG, HS, HA, HH, HN, NN, NT and RN. The di-residues HH, HS, NT, HK and RN do not appear to occur in *Xanthomonas* TALE proteins Position 12 mostly displays H, whereas position 13 is more variable, which suggests that the specificity with respect to the different nucleobases could also rely more particularly on position 13.

When considering amino acids that are present in more than 50% of the modules, the following consensus sequence can be drawn:

L - P - D I V S I A S H - G - - K - I

T - L L - KW - - L - - LG, where the symbol "-" means a standard amino acid which is more variable.

The above consensus sequences are fully distinct from that of AvrBs3 repeats.

It has the following common characteristics with the previous BURRH consensus:

- - - - D I V - I A - - - G - - - -

- - - - L - - - - - L - - -G

BRIEF DESCRIPTION OF THE FIGURES

FIG. 2: Alignment of the different modules of E5AV36, E5AW43 and E5AW45.

FIG. 4: Matrix showing the number of times each amino acid is represented at positions 1 to 33 in the BURRH modules.

FIG. 5: Alignment of the modules of JCVI_A (Table 29), JCVI_B (Table 30) and
ECR81667 (Table 31).

FIG. 7: Matrix showing the number of times each amino acid is represented at positions 1 to 33 in the JCVI_A (Table 29), JCVI_B (Table 30) and ECR81667 (Table 31) modules.

FIG. 8: Affinity of the BurrH_36 derived nuclease onto different putative targets A, B and C that have been recognized and cleaved in SSA assay. This shows the base per base apparent affinity of the different modules with respect to the nucleotide bases present on these targets. Experiments are detailed in Example 1.

FIG. 10: Examples of targeted mutagenesis (indels) at the desired locus using BurrH_36 derived nuclease (see example 7).

FIG. 11: Alignment of wild type genomic sequence and most predominant mutants (deletions are highlighted by dashes) induced by the BurrH nuclease (18 modules) at the CAPNS1 locus.

FIG. 12: Alignment of wild type genomic sequence and most predominant mutants (deletions are highlighted by dashes) induced by the BurrH nuclease (20 modules) at the CAPNS1 locus.

FIGS. 16A and B: A. Insertion or mutation of amino acid residues in the N-terminal domain of BurrH_36 to enhance BurrH 36 nuclease activity. A. Alignment of the wild type N-terminal domain of BurrH_36 (SEQ ID NO. 7) and mutated N-terminal domain of BurrH_36 (pCLS21512 to pCLS21520; SEQ ID NO 399 to SEQ ID NO. 407). B. Alignment of wild type N-terminal domain of BurrH_36 and N-terminal domain pCLS21521 (SEQ ID NO: 408) in which the 26 first amino acids of the N-terminal domain of BurrH_36 (SEQ ID NO.2) have been replaced by the 74 first amino acids from the D152 N-terminal domain of AvrBS3 (SEQ ID NO. 366) and comprising seven point mutations.

BRIEF DESCRIPTION OF THE TABLES

Figure 1D:
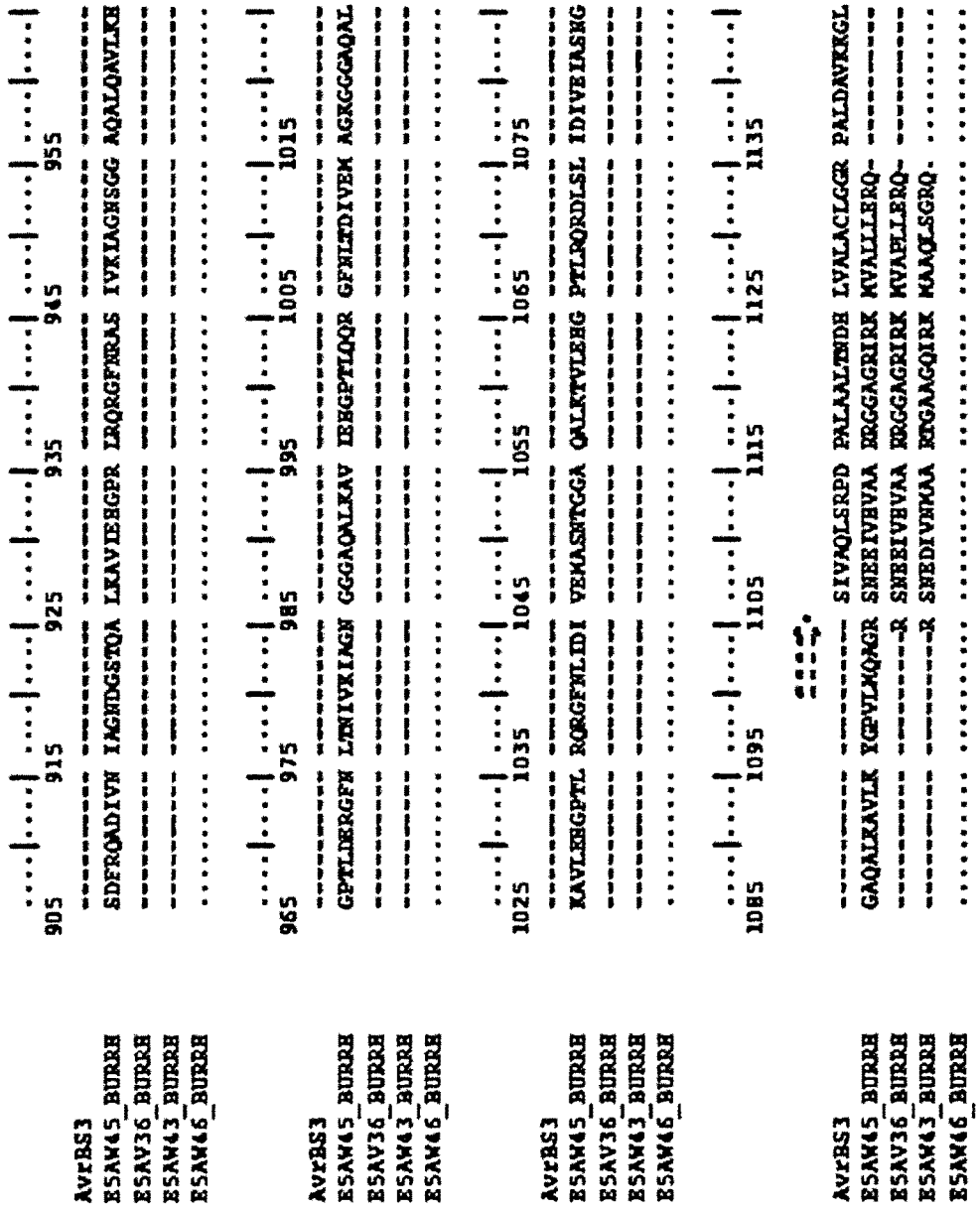
FIGS. 1A, B, C, and D: Clustal W alignment of the proteins sequences E5AV36, E5AW43, E5AW45, E5AW46 from BURRH and of AvrBs3 (SEQ ID NO.1) using a segment to segment approach. The arrow indicates the start of modules sequences.
Figure 3:
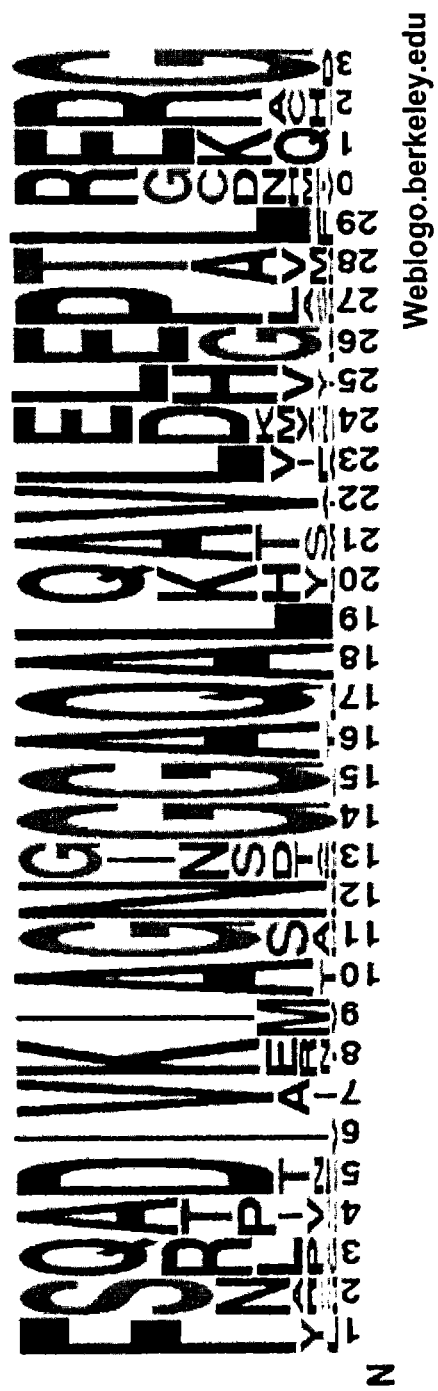
FIG. 3: Logotype representation of the amino acids occurrence at positions 1 to 33 in the modules of BURRH proteins E5AV36, E5AW43 and E5AW45.
Figure 6:
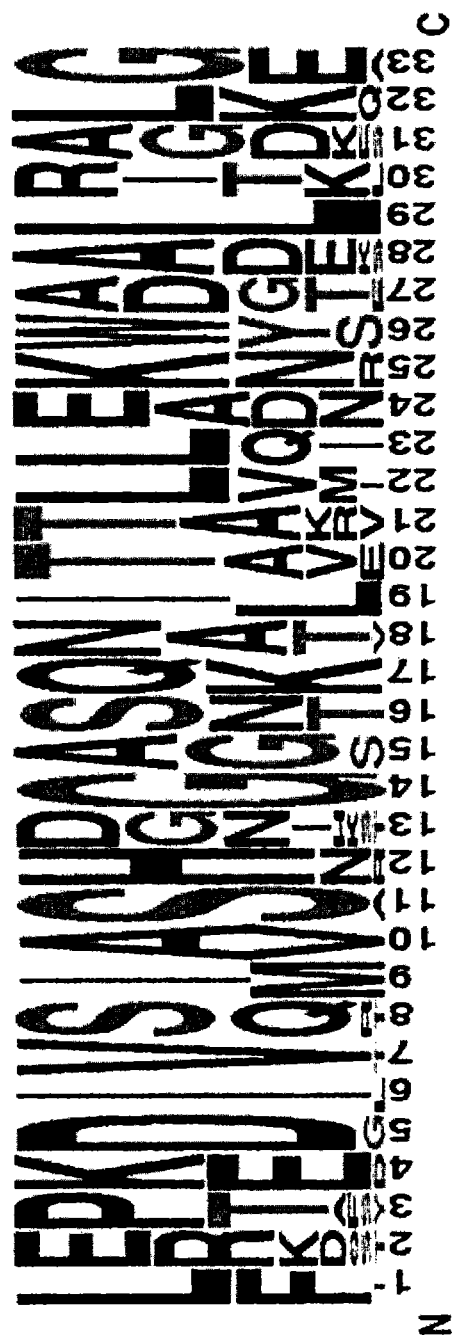
FIG. 6: Logotype representation of the amino acids occurrence at positions 1 to 33 in the modules of JCVI_A and JCVI_B

Table 1: List of all pseudo-palindromic sequences targets (two identical recognition sequences are placed facing each other on both DNA strands—minuscule letters represent spacers) used in yeast SSA assay.

Table 2: Activity of BurrH_36 derived nuclease on pseudo-palindromic sequences targets (two identical recognition sequences are placed facing each other on both DNA strands) in yeast SSA assay.

Table 3: List of all pseudo-palindromic (two identical recognition sequences are placed facing each other on both DNA strands) sequences targets, with various nucleotides in position 0, -1 and -2 used in yeast SSA assay.

Table 4: Activity of BurrH_36 derived nuclease on pseudo-palindromic sequences targets listed in Table 3 in yeast SSA assay.

Table 5: Sequences of the module domains of BurrH_36 based constructs containing 18 DNA binding modules (Example 3).

Table 6: List of all pseudo-palindromic (two identical recognition sequences are placed facing each other on both DNA strands) sequences targets, with various spacer length (ranging from 5 to 40 bp) used in yeast SSA assay.

Table 7: Activity of BurrH_36 derived nuclease on pseudo-palindromic sequences targets listed in Table 6 in yeast SSA assay.

Table 8: Sequences of the module domains of BurrH_36 based constructs containing 16 DNA binding modules (Example 4).

Table 9: List of the 2 pseudo-palindromic (two recognition sequences are placed facing each other on both DNA strands) sequences targets, used in yeast and mammalian SSA assay.

Table 10: Activity of BurrH_36 derived nuclease on pseudo-palindromic sequences targets listed in Table 9 in yeast SSA assay.

Table 11: Sequences of the 16 module domains of pCLS18477 construct derived from the alignment of the first 5 modules of E5AV36.

Table 12: Sequences of the 16 module domains of pCLS18478 construct derived from the alignment of all the E5AV36 modules.

Table 13: Sequences of the 16 module domains of pCLS18479 construct derived from the alignment of all the E5AV36 modules (Example 5).

Table 14: Activity of BurrH_36 derived nuclease on one of the pseudo-palindromic sequences targets listed in Table 9 in yeast SSA assay.

Table 15: Activity of BurrH_36 derived nuclease on AVR15 sequences targets in yeast SSA assay at 37° C. +++ indicates a high activity.

Table 16: List of all pseudo-palindromic (two identical recognition sequences are placed facing each other in the 5'/5' (or N/N) orientation on both DNA strands) sequences targets, with various spacer sizes used in our yeast SSA assay previously described (International PCT Applications WO 2004/067736 and in (Epinat, Arnould et al. 2003; Chames, Epinat et al. 2005; Arnould, Chames et al. 2006; Smith, Grizot et al. 2006).

Table 17: List of all targets having a single RAGT2.4 DNA target sequences preceding a single AvrBs3 (on the same DNA strand), with various spacer sizes used in our yeast SSA assay previously described (International PCT Applications WO 2004/067736 and in (Epinat, Arnould et al. 2003; Chames, Epinat et al. 2005; Arnould, Chames et al. 2006; Smith, Grizot et al. 2006)

Table 18: Activity of BurrH_36 derived nuclease on one of the pseudo-palindromic sequences targets listed in Table 16 and 17 in yeast SSA assay at 37° C. – indicates no detectable activity, + indicates a low activity, ++a medium activity and +++a high activity Table 19: Activity of BurrH_36 derived nuclease on RAGT2.3 and RAGT2.4 sequences targets in yeast SSA assay at 37° C. – indicates no detectable activity, + indicates a low activity, and +++ a high activity.

Table 20: Activity of BurrH_36 derived chimera nuclease on RAGT2.3 and RAGT2.4 sequences targets in yeast SSA assay at 37° C. – indicates no detectable activity, and +++a high activity.

Table 21: Activity of BurrH_36 derived nuclease containing mutations in the N-terminal domain on Avr15 sequence target in yeast SSA assay at 37° C. – indicates no detectable activity, and +++ a high activity.

Table 22: Activity of monomeric MBBBD nuclease in yeast (37° C.). Activity of TevD02::b36-AvrBs3 and TevM01::b36-AvrBs3 on DNA target containing natural I-TevI cleavage site (CAAGC) wherein the terminal G base of the I-TevI cleavage site is spaced away of 10 bp from the residue preceded the single AvrBs3 recognition site (SEQ ID NO. 425). Table 23: Alignment of the N-terminal sequences of E5AV36, E5AW45 and E5AW46 BURRH proteins with N-terminal sequence of AvrBs3 (DIALIGN format).

Table 24: Alignment of the C-terminal sequences of E5AV36, E5AW45 and E5AW46 BURRH proteins with C-terminal sequence of AvrBs3 (DIALIGN format).

Table 25: Sequence identity matrix showing percentages of identity between the N-terminal amino acids sequences of E5AV36, E5AW45 and E5AW46 and AvrBs3.

Table 26: Sequence identity matrix showing percentages of identity between the C-terminal amino acids sequences of E5AV36, E5AW45 and E5AW46 and AvrBs3.

Table 27: Amino acid sequences of the modules of E5AV36, E5AW43 and E5AW45.

Table 28: Matrix comparing the identity of the amino acid sequences of the different modules from E5AV36, EAW45, E5AW43 and AvrBs3.

Table 29: Amino acid sequences of the putative protein JCVI_A (SEQ ID NO.72) resulting from the fusion of ECG96325 (SEQ ID NO.68) and ECG96326 (SEQ ID NO. 69).

Table 30: Amino acid sequences of the putative protein JCVI_B (SEQ ID NO.73), resulting from the fusion of EBN19408 (SEQ ID NO.70) and EBN19409 (SEQ ID NO.67)

Table 31: Amino acid sequences of the putative protein JCVI_ORF_1096688327480 (ECR81667) (SEQ ID NO.71).

Table 32: Alignment of the N-terminal sequences of JCVIA and JVCIB with those of E5AV36, E5AW45, E5AW43 and AvrBS3 (DIALIGN format).

Table 33: Alignment of the C-terminal sequences of JCVIA and JVCIB with those of E5AV36, E5AW45, E5AW43 and AvrBS3 (DIALIGN format).

Table 34: List of peptide linkers that can be used in MBBBD proteins.

DETAILED DESCRIPTION OF THE INVENTION

General Method for Identifying Genomic Members as a Source of Module Domains

As a primary embodiment of the invention is a method to identify putative genomic sequences that may encode modules having specificity to nucleic acid bases. In the present situation, the identification of module sequences according to the invention has come across the following difficulties:

Lack of identity with any known repeat sequences, especially with *Xanthomonas* TALEs;
Degeneration of the genetic code to pass from polypeptide to polynucleotides;
Different codon usage depending of the different genomes of organisms;
Higher sequence variability between the module sequences; and
High number of genomic sequences in database to process.

In order to overcome these difficulties, the invention provides with an approach based on occurrence of repeated structures in putative proteins without taking into account the *Xanthomonas* TALEs known amino acid sequences. The method is based, as a first screening, on the identification of aminoacidic sequences containing module motifs of variable length (between 20 and 50 aa) using a large variety of computational techniques. Then the candidate sequences are submitted to secondary structure predictions. All the candidates whose module motifs display a high content of alpha helices joined by small loops (whose primary sequence is highly polymorphic) are kept. Finally the entire sequences of the candidates (not only their module motives) are modelled on the available 3D structures. This step allows the identification of the correct number of domains constituting the entire candidate sequences as well as a first functional identification of the key residues regulating the activity of the new putative DNA binding proteins.

As a first result, said method has permitted the identification of proteins referred to as being related to the AraC protein family. Interestingly, some proteins of the AraC family have been described as containing DNA-binding domains having the ability of establishing DNA-base contacts (Bustos and Schleif 1993). However, to the inventor's knowledge, modular sequences have not been yet reported in connection with AraC DNA binding domains.

Thus, one aspect of the present invention concerns the use of polypeptide sequences referred to in databases as belonging to the AraC protein family as a source of new modules for engineer base per base specific DNA binding domain. In particular, the present invention has for object the use of DNA binding domains from protein referred to as AraC proteins in genomic databases, especially those domains having nucleic acid base specificity, to form fusion proteins for recognition of specific nucleic acid target sequences. As a result, DNA recognition protein domains may be assembled in order to pair off with a specific nucleic acid base sequence and be fused to catalytic domains to form a new generation of binding proteins.

New Polypeptides Derived from Metagenomic JCVI_A, JCVI_B and ECR81667 Proteins and from the BURRH Proteins E5AV36, E5AW43, E5AW45 and E5AW4, and their Use to Engineer Base Per Base Binding Domains (MBBBD)

As a further embodiment of the invention are the polypeptides derived from the BURRH proteins E5AV36, E5AW43, E5AW45 and E5AW46 and from the metagenomic JCVI_A, JCVI_B and ECR81667 proteins. These polypeptides may consist of the whole proteins or of their different domains as previously described especially the different modules, N and C-terminal domains of these proteins.

Because some variability may arise from the genomic data from which these polypeptides derive, and also to take into account the possibility to substitute some of the amino acids present in these polypeptides without significant loss of activity (functional variants) and also because the modules have a significant variability (some share less than 50% identity), the invention encompasses polypeptides variants of the above polypeptides that share at least 70%, preferably at least 80%, more preferably at least 90% and even more preferably at least 95% identity with the sequences provided in this patent application.

The present invention is thus drawn to polypeptides comprising a polypeptide sequence that has at least 60%, preferably 70%, more preferably at least 80%, again more preferably at least 90%, 95% 97% or 99% sequence identity with any of the above disclosed polypeptide sequences encoding modules, N or C-terminals. The invention more particularly relates to the use any polypeptide of sequence SEQ ID NO.11 to 63 and SEQ ID NO.77 to 108 as a new or alternative module, and/or any of said polypeptides of sequence SEQ ID NO.7 to 9 or SEQ ID NO. 74 to 76 as new or alternative N-terminal domain, and/or any of said polypeptides of sequence SEQ ID NO.64 to 66 or SEQ ID NO. 109 to 111 as a new or alternative C-terminal, in particular for introduction into existing AvrBs3-like TALE proteins (chimeric proteins).

The invention also relates to a polypeptide module or modular binding domain of an engineered protein that comprises a module sequence from a protein of the AraC family, especially a module sequence of 30 to 40 amino acids, preferably from 30 to 33 amino acids.

The polypeptide modules according to the invention are particularly useful to engineer "artificial" nucleic acid binding domains. By "artificial" is meant that they are assembled or modified to bind a desired nucleic acid sequence, said desired target sequence being different from that initially recognized by the proteins JCVI_A, JCVI_B, ECR81667 and BURRH proteins E5AV36, E5AW43, E5AW45 and E5AW4 in the wild.

The assembly is generally made by selecting the modules in respect of the affinity of each module to a given nucleic acid base, preferably on a base per base basis. The selection can be made in particular by reference to said one amino-acid/one base code recognition established by the inventors, but can also be made according to other criteria of specificity. Said one amino-acid/one base code recognition can be based on the following correspondences (AA: amino acid preferably in position 13 of the module):

Primary Code

| AA | Nucleotide base |
|---|---|
| I | A |
| G | T |
| D | C |
| N | G |

Possible alternative recognition may be implemented using the following correspondences:

Secondary Code

| AA | Nucleotide base |
|---|---|
| S, T | A |
| R | T |
| T, * | C |
| R | G |

The symbol "*" (star) means a gap i.e. that there is no position aligned with the amino acid in position 13 using clustal alignment of the different modules.

This straightforward code according to the present invention may also be used to modify the specificity of the polypeptide modules by directly introducing mutations in any of the module polypeptides described previously, especially in position 13.

The polynucleotide encoding the artificial nucleic acid binding domains of the invention can be assembled by cloning the polynucleotide sequences encoding the different polypeptides by the methods known in the art or by using a solid phase and Type IIS restriction enzymes as described in WO2013/017950 with respect to repeats from TAL binding domains, or even by automated polynucleotide synthesis. The produced polynucleotides can then be cloned into various expression or replication vectors to be transfected into living cells.

In one embodiment of the invention, modules of 32, 31 or less amino acids, such as those having identity to SEQ ID NO. 30, 38, 41, 50 and 63 can be used into such artificial nucleic acid binding domains. All the polypeptide modules or mutations according to the present invention can also be introduced into, or assembled with, TAL repeats, to form chimeric MBBBDs (see chimeric proteins).

"Identity" refers to sequence identity between two nucleic acid molecules or polypeptides. Identity can be determined by comparing a position in each sequence which may be aligned for purposes of comparison. When a position in the compared sequence is occupied by the same base, then the molecules are identical at that position. A degree of similarity or identity between nucleic acid or amino acid sequences is a function of the number of identical or matching nucleotides at positions shared by the nucleic acid sequences. Various alignment algorithms and/or programs may be used to calculate the identity between two sequences, including FASTA, or BLAST which are available as a part of the GCG sequence analysis package (University of Wisconsin, Madison, Wis.), and can be used with, e.g., default setting. BLASTP may also be used to identify an amino acid sequence having at least 80%, 85%, 87.5%, 90%, 92.5%, 95%, 97.5%, 98%, 99% sequence similarity to a reference amino acid sequence using a similarity matrix such as BLOSUM45, BLOSUM62 or BLOSUM80. Unless otherwise indicated a similarity score will be based on use of BLOSUM62. When BLASTP is used, the percent similarity is based on the BLASTP positives score and the percent sequence identity is based on the BLASTP identities score. BLASTP "Identities" shows the number and fraction of total residues in the high scoring sequence pairs which are identical; and BLASTP "Positives" shows the number and fraction of residues for which the alignment scores have positive values and which are similar to each other. Amino acid sequences having these degrees of identity or similarity or any intermediate degree of identity of similarity to the amino acid sequences disclosed herein are contemplated and encompassed by this disclosure. The same applies with respect to polynucleotide sequences using BLASTN.

By "TALE-like polypeptide" is intended any polypeptide or protein comprising a binding domain formed by at least two repeats, preferably at least 5, more preferably at least 10, even more preferably at least 14 repeats from a TALE protein having more than 80% identity with AvrBs3 from *Xanthomonas*, each of said repeat having specificity for a nucleic acid base. In general the repeats do not overlap and form a succession of repeats comprising RVDs. This succession and order of the RVDs, so-called "RVD sequence" may be modified by assembling repeats together to form engineered TALE-like binding domains, thereby allowing targeting any desired sequence in-vivo or in-vitro. According to the invention, modules as disclosed herein may replace some of the AvrBs3-like repeats in such proteins to form new TALE-like chimeric polypeptides.

Some modules from the polypeptides according to the invention comprise variable residues in position 12 and 13, in particular NT, **, KG, NR, RN, HS, HH and/or HK which may be independently introduced in any existing TALE repeats or in any TALE-like polypeptide as described herein, to improve or modulate their specificity with respect to their cognate nucleic acid bases.

Fusion Proteins

The polypeptides according to the invention previously described may be fused with any other polypeptides to form single chain, monomer or multimer proteins.

In particular, the above polypeptides can be fused with catalytic domains in order to activate or inactivate transcription or translation activity or process genetic material, within or adjacent to the nucleic acid sequence targeted by the MBBBD. Said catalytic domain can have cleavage activity, either a cleavase activity either a nickase activity, more broadly a nuclease activity but also a polymerase activity, a kinase activity, a phosphatase activity, a methylase activity, a topoisomerase activity, an integrase activity, a transposase activity, a ligase, a helicase or recombinase activity as non-limiting examples.

Suitable domains for achieving activation include the HSV VP16 activation domain (see, e.g., Hagmann et al., *J. Virol.* 71, 5952-5962 (1997)) nuclear hormone receptors (see, e.g., Torchia et al., *Curr. Opin. Cell. Biol.* 10:373-383 (1998)); the p65 subunit of nuclear factor kappa B (Bitko & Barik, *J. Virol.* 72:5610-5618 (1998) and Doyle & Hunt, Neuroreport 8:2937-2942 (1997)); Liu et al., *Cancer Gene Ther.* 5:3-28 (1998)), or artificial chimeric functional domains such as VP64 (Beerli et al., (1998) *Proc. Natl. Acad. Sci. USA* 95:14623-33), and degron (Molinari et al., (1999) *EMBO J.* 18, 6439-6447). Additional exemplary activation domains include, Oct 1, Oct-2A, Sp1, AP-2, and CTF1 (Seipel et al., *EMBO J.* 11, 4961-4968 (1992) as well as p300, CBP, PCAF, SRC1 PvALF, AtHD2A and ERF-2. See, for example, Robyr et al. (2000) *Mol. Endocrinol.* 14:329-347; Collingwood et al. (1999) *J. Mol. EndocrinoL* 23:255-275; Leo et al. (2000) *Gene* 245:1-11; Manteuffel-Cymborowska (1999) *Acta Biochim. Pol.* 46:77-89; McKenna et al. (1999) *J. Steroid Biochem. Mol. Biol.* 69:3-12; Malik et al. (2000) *Trends Biochem. Sci.* 25:277-283; and Lemon et al. (1999) *Curr. Opin. Genet. Dev.* 9:499-504. Additional exemplary activation domains include, but are not limited to, OsGAI, HALF-1, C1, AP1, ARF-5, -6, -7, and -8, CPRF1, CPRF4, MYC-RP/GP, and TRAB1. See, for example, Ogawa et al. (2000) *Gene* 245:21-29; Okanami et al. (1996) *Genes Cells* 1:87-99; Goff et al. (1991) *Genes Dev.* 5:298-309; Cho et al. (1999) *Plant Mol. Biol.* 40:419-429; Ulmason et al. (1999) *Proc. Natl. Acad. Sci. USA* 96:5844-5849; Sprenger-Haussels et al. (2000) *Plant J.* 22:1-8; Gong et al. (1999) *Plant Mol. Biol.* 41:33-44; and Hobo et al. (1999) *Proc. Natl. Acad. Sci. USA* 96:15,348-15,353.

Exemplary repression domains include, but are not limited to, KRAB A/B, KOX, TGF-beta-inducible early gene (TIEG), v-erbA, SID, MBD2, MBD3, members of the DNMT family (e.g., DNMT1, DNMT3A, DNMT3B), Rb, and MeCP2. See, for example, Bird et al. (1999) *Cell* 99:451-454; Tyler et al. (1999) *Cell* 99:443-446; Knoepfler et al. (1999) *Cell* 99:447-450; and Robertson et al. (2000) *Nature Genet.* 25:338-342. Additional exemplary repression domains include, but are not limited to, ROM2 and AtHD2A. See, for example, Chem et al. (1996) *Plant Cell* 8:305-321; and Wu et al. (2000) *Plant J.* 22:19-27.

The above polypeptides may also be fused with reporter or selection markers such as GFP and GUS as non limiting examples.

By "catalytic domain" is intended the protein domain or module of an enzyme containing the active site of said enzyme; by active site is intended the part of said enzyme at which catalysis of the substrate occurs. Enzymes, but also their catalytic domains, are classified and named according to the reaction they catalyze. The Enzyme Commission number (EC number) is a numerical classification scheme for enzymes, based on the chemical reactions they catalyze (http://www.chem.qmul.ac.uk/iubmb/enzyme/).

Said catalytic domain has preferably an enzymatic activity selected from the group consisting of nuclease activity, polymerase activity, kinase activity, phosphatase activity, methylase activity, topoisomerase activity, integrase activity, transposase activity or ligase activity. In another preferred embodiment, the catalytic domain fused to the MBBBD polypeptides of the present invention can be a transcription activator or repressor (i.e. a transcription regulator), or a protein that interacts with or modifies other proteins such as histones. Non-limiting examples of nucleic acid processing activities of said fusion MBBBD polypeptides of the present invention include, for example, creating or modifying epigenetic regulatory elements, making site-specific insertions, deletions, or repairs in DNA, controlling gene expression, and modifying chromatin structure.

Catalytic domains that may be fused to the MBBBD polypeptides can be selected, for instance, from the group consisting of proteins MmeI, Colicin-E7 (CEA7_ECOLX), EndA, Endo I (END1_ECOLI), Human Endo G (NUCG_HUMAN), Bovine Endo G (NUCG_BOVIN), R.HinP1I, I-BasI, I-BmoI, I-HmuI, I-Tev-I, I-TevII, I-TevIII, I-TwoI, R.MspI, R.MvaI, NucA, NucM, Vvn, Vvn_CLS, Staphylococcal nuclease (NUC_STAAU), Staphylococcal nuclease (NUC_STAHY), Micrococcal nuclease (NUC_SHIFL), Endonuclease yncB, Endodeoxyribonuclease I (ENRN_BPT7), Metnase, Nb.BsrDI, BsrDI A, Nt.BspD6I (R.BspD6I large subunit), ss.BspD6I (R.BspD6I small subunit), R.PleI, MlyI, AlwI, Mva1269I, BsrI, BsmI, Nb.BtsCI, Nt.BtsCI, R1.BtsI, R2.BtsI, BbvCI subunit 1, BbvCI subunit 2, Bpu10I alpha subunit, Bpu10I beta subunit, BmrI, BfiI, I-CreI, hExoI (EXO1_HUMAN), Yeast ExoI (EXO1_YEAST), E. coli ExoI, Human TREX2, Mouse TREX1, Human TREX1, Bovine TREX1, Rat TREX1, Human DNA2, Yeast DNA2 (DNA2_YEAST), VP16, RBBP8 and Type IIS nucleases like Fok-I and functional variants thereof.

By "functional variants" is intended a catalytically active variant of a protein, such variant can have additional properties compared to its parent protein. Amino acid sequence variants of the peptide can be prepared by mutations in the DNA which encodes the peptide. Such variant comprise, for example, deletions from, or insertions or substitutions of residues within the amino acid sequence. Any combination of deletion, insertion or substitutions may also be made to arrive at the final construct, provided that the final construct possesses the desired activity.

The catalytic domain is preferably a nuclease domain and more preferably a domain having nuclease activity, like for instance I-Tev-I, Col E7, NucA and Fok-I.

In a particular embodiment, said polypeptides that specifically target nucleic acid sequence of interest may be fused to any catalytic domains that require dimerization for activity. As non limiting example, said polypeptide may be fused to the type IIS FokI endonuclease domain or functional variant thereof which functions independently of the DNA binding domain and induces nucleic acid double-stranded cleavage as a dimer (Li, Wu et al. 1992; Kim, Cha et al. 1996). Amino acid sequence of FokI variants can be prepared by mutations in the DNA, which encodes the catalytic domain. Such variants include, for example, deletions from, or insertions or substitutions of, residues within the amino acid sequence. Any combination of deletion, insertion, and substitution may also be made to arrive at the final construct, provided that the final construct possesses the desired activity. Said nuclease domain of FokI variant according to the present invention comprises a fragment of a protein sequence having at least 80%, more preferably 90%, again more preferably 95% amino acid sequence identity with the protein sequence of FokI (SEQ ID NO.123).

The targeted nucleic acid sequence of interest are preferably selected with respect to each other, such that the binding of the two fusion polypeptides to their respective target sites places each monomers of the endonuclease in a spatial orientation that allows the formation of a functional cleavage domain by dimerizing. In some embodiments, the spacer of the targeted nucleic acid sequences can be selected or varied to modulate MBBD nuclease specificity and activity. Thus in certain embodiment, the near edge of the target sites are separated by 5 to 50 nucleotides, preferably by 10-30 nucleotides or 25-40 nucleotides.

In another particular embodiment, said fusion protein is a monomeric MBBBD-nuclease. A monomeric MBBBD-nuclease is a MBBBD that does not require dimerization for specific recognition and cleavage, such as the fusions of engineered MBBBD modules with the catalytic domain of I-TevI.

I-TevI catalytic domain corresponds to the protein domain or module of an enzyme containing the active site of said enzyme; by active site is intended the part of said enzyme at which catalysis of the substrate occurs. In the scope of the present invention, I-TevI catalytic domain can provide nuclease activity.

By "nuclease catalytic domain" is intended the protein domain comprising the active site of an endonuclease enzyme. Such nuclease catalytic domain may generate a cleavage in a nucleic acid target sequence that corresponds to either Double Strand Break (DSB) (cleavase activity) in a nucleic acid target or a single strand break in a nucleic acid target sequence (nickase activity).

Said catalytic domain can be I-TevI or a variant thereof. In a preferred embodiment, said catalytic domain is a variant of catalytic domain of I-TevI designed from the N-terminal region of I-TevI. Said catalytic domain comprises a part of the protein sequence SEQ ID NO. 413. In a preferred embodiment, said I-TevI catalytic domain corresponds to the amino acid sequence of SEQ ID NO. 416 or SEQ ID NO: 417. Alternatively, amino acid sequence variants of the catalytic domain I-TevI can be prepared by mutations in the DNA, which encodes the catalytic domain. Such variants include, for example, deletions from, or insertions or substitutions of, residues within the amino acid sequence. Any combination of deletion, insertion, and substitution may also be made to arrive at the final construct, provided that the final construct possesses the desired activity.

In a particular embodiment, said catalytic domain of I-TevI according to the present invention comprises a fragment of a protein sequence having at least 80%, more preferably 90%, again more preferably 95% amino acid sequence identity with the protein sequence SEQ ID NO. 413. In a preferred embodiment, said catalytic domain of I-TevI comprises a protein sequence having at least 80%, more preferably 90%, again more preferably 95% amino acid sequence identity with the protein sequence SEQ ID NO. 416 or SEQ ID NO. 417.

TevI fused MBBBD nuclease interacts with two regions in target nucleic acid sequence:

the recognition site and the cleavage site. Optimal distances in the target nucleic acid sequence for the relative positioning of the binding and cleavage modules in the TevI fused MBBBD polypeptide have been determined. Thus, the present invention relates to a MBBBD polypeptide capable of targeting a nucleic acid sequence that comprises a recognition site spaced away from said I-TevI cleavage site by an optimal distance to increase DNA processing activity.

Increased DNA processing activity refers to an increase in the detected level of MBBBD nuclease processing activity against a target nucleic acid sequence. In the present invention, nucleic acid processing activity refers to a cleavage, either a cleavase activity or a nickase activity. By optimal distance is intended the distance between said recognition site and I-TevI cleavage site allowing an increase in DNA processing activity of the TevI chimeric endonuclease. An optimal distance is considered when it provides at least a 5% increase efficiency of DNA processing activity, more preferably 10%, again more preferably 15%, again more preferably 20%, again more preferably 25%, again more preferably 50%, again more preferably greater than 50%.

In particular embodiment, DNA binding recognition site is also chosen based upon its optimal spacer between the residue preceded the first nucleic acid base of DNA binding recognition site and the terminal G base of the I-TevI cleavage site. In a preferred embodiment, the optimal spacer distance is between 1 to 50 bp, more preferably between 4 to 12 bp, again more preferably is 4, 5, 6, 7, 8, 9, 10, 11 or 12 bp.

In certain embodiment, the nuclease is a meganuclease (homing endonuclease) or variant thereof. Naturally-occurring meganucleases recognize 15-40 base-pair cleavage sites and are commonly grouped into four families: the LAGLIDADG family, the GIY-YIG family, the His-Cyst box family and the HNH family. Exemplary homing endonucleases include I-Sce I, I-Chu I, I-Cre I, I-Csm I, PI-Sce I, PI-Tli I, PI-Mtu I, I-Ceu I, I-Sce II, I-Sce III, HO, PI-Civ I, PI-Ctr I, PI-Aae I, PI-Bsu I, PI-Dha I, PI-Dra I, PI-May I, PI-Mch I, PI-Mfu I, PI-Mfl I, PI-Mga I, PI-Mgo I, PI-Min I, PI-Mka I, PI-MIe I, PI-Mma I, PI-Msh I, PI-Msm I, PI-Mth I, PI-Mtu I, PI-Mxe I, PI-Npu I, PI-Pfu I, PI-Rma I, PI-Spb I, PI-Ssp I, PI-Fac I, PI-Mja I, PI-Pho I, PI-Tag I, PI-Thy I, PI-Tko I, PI-Tsp I or I-Msol, PI-PspI, I-SceIV, I-PanI, I-OnuI, I-PpoI, I-TevI, I-TevII and I-TevIII. In a preferred embodiment, the homing endonuclease according to the invention is a LAGLIDADG endonuclease such as I-SceI, I-CreI, I-CeuI, I-OnuI, I-Msol, and I-DmoI. In a most preferred embodiment, said LAGLIDADG endonuclease is I-CreI. Wild-type I-CreI is a homodimeric homing endonuclease that is capable of cleaving a 22 to 24 bp double-stranded target sequence.

In the present application, homing endonuclease variants such as I-CreI may be homodimers (meganuclease comprising two identical monomers) or heterodimers (meganuclease comprising two non-identical monomers). It is understood that the scope of the present invention also encompasses the homing endonuclease variants per se, including heterodimers (WO2006097854), obligate heterodimers (WO2008093249) and single chain meganucleases (WO03078619 and WO2009095793) as non limiting examples, able to cleave one of the sequence targets in the cell genome. The invention also encompasses hybrid variant per se composed of two monomers from different origins (WO03078619).

The invention encompasses both wild-type and variant endonucleases. In a preferred embodiment, the endonuclease according to the invention is a "variant" endonuclease, i.e. an endonuclease that does not naturally exist in nature and that is obtained by genetic engineering or by random mutagenesis. The variant endonuclease according to the invention can for example be obtained by substitution of at least one residue in the amino acid sequence of a wild-type, endonuclease with a different amino acid. Said substitution(s) can for example be introduced by site-directed mutagenesis and/or by random mutagenesis. In the frame of the present invention, such variant endonucleases remain functional, i.e. they retain the capacity of recognizing and specifically cleaving a target sequence. The variant endonuclease according to the invention cleaves a target sequence that is different from the target sequence of the corresponding wild-type endonuclease. Methods for obtaining such variant endonucleases with novel specificities are well-known in the art.

Said catalytic domain might be at the N-terminal part or C-terminal part of said MBBBD. In a particular embodiment, Said catalytic domain is fused to MBBBD by a peptide linker. Peptide linker acts as a communication device between the MBBBD polypeptide and catalytic domain to act in concert for nucleic acid cleavage. Said peptide linkers can be of various sizes, preferably from 2 to 50 amino acids, more preferably from 3 to 10 amino acids and can be selected from the group consisting of NFS1, NFS2, CFS1, RM2, BQY, QGPSG, LGPDGRKA, 1a8h_1, 1 dnpA_1, 1 d8cA_2, 1 ckqA_3, 1 sbp_1, 1 ev7A_1, 1 alo_3, 1 amf_1, 1 adjA_3, 1 fcdC_1, 1al3_2, 1 g3p_1, 1 acc_3, 1 ahjB_1, 1 acc_1, 1 af7_1, 1 heiA_1, 1 bia_2, 1 igtB_1, 1 nfkA_1, 1 au7A_1, 1 bpoB_1, 1 b0 pA_2, 1c05A_2, 1 gcb_1, 1 bt3A_1, 1 b3oB_2, 16 vpA_6, 1 dhx_1, 1 b8aA_1 and 1qu6A_1 and peptide linkers listed in Table 34 (SEQ ID NO.451 to SEQ ID NO.535).

In a more preferred embodiment, the peptide linker that can link said catalytic domain to the MBBBD polypeptide according to the method of the present invention can be selected from the group consisting of GRSGSDP (SEQ ID NO: 489), QGPSG (SEQ ID NO: 487), IA (SEQ ID NO.90) or SG (SEQ ID NO: 491). Peptide linkers between the MBBBD polypeptide and the catalytic domain can be constructed to be either flexible or positionally constrained to allow for the most efficient activity targeted nucleic acid processing.

Example 1 below shows that the above polypeptides have the ability to dimerize when fused to the catalytic domain of the nuclease Fok-I. A fusion of BurrH_36 with Fok-I has been achieved to form a sequence specific nuclease being able to cut a putative artificial nucleic acid target. Interestingly, this fusion experiment revealed that, contrary to TALE-Nucleases, there was no requirement for T in the target DNA sequence for the first module to bind said nucleic acid target. It is unclear at the moment whether it is due to the N-terminus (SEQ ID NO.7) or to the first module (SEQ ID NO.11) of the BurrH protein. However, these polypeptides provide a significant advantage over the TALE-Nuclease of the prior art in this regard.

Accordingly, the invention also provides modular polypeptides or N-terminal sequences to alleviate the requirement of a T in sequences to be targeted by a TALE or TALE-like binding domain. Such module or N-terminal domain according to the invention may thus be introduced in TALE or TALE-like repeat binding domains to overcome the requisite T nucleotide at position −1 in nucleic acid target sequences.

Truncations, spacers and linkers may be added by one skilled in the art to the polypeptides according to the invention to optimize their binding activity or the catalytic activity conferred by their catalytic domains. The catalytic domain that is capable of processing genetic material within or adjacent the nucleic acid target sequence of interest can be fused to the N- or C-terminus part of said binding domains of the invention. In a preferred embodiment two catalytic domains having complementary or distinct activities are fused to both N-terminus and C-terminus parts of said binding domains.

Chimeric Proteins

According to a further aspect of the invention, the polypeptides and fusion proteins previously described can be used to create chimeric proteins, which incorporate sequences from AvrBs3-like proteins, in particular repeats, N-terminal or C-terminal sequences thereof.

Accordingly, the invention provides engineered TALE-like proteins with a binding domain comprising a mix of the modules according to the invention and of AvrBs3-like repeats. By providing a larger choice of modules of various affinities with the nucleic acid bases, it is intended to increase the modularity and the various possibilities of assembly within MBBBDs to create customized nucleic acid binding domains.

Meanwhile, new scaffolds can be derived from AvrBs3-like proteins comprising a module, N or C terminals, or any functional part of the polypeptides from E5AV36, E5AW43, E5AW45, E5AW46, JCVI_A, JCVI_B and ECR81667 previously described. More generally, the chimeric protein of the present invention can be derived from any naturally occurring TAL effectors, such as those described by (Moscou and Bogdanove 2009) and in WO 2011072246., that comprise repeats of 33 to 35 amino acids, wherein two critical amino acids located at positions 12 and 13 (RVD) mediate specific nucleic acid base recognition. In such chimeric proteins, the following RVDs can be used: HD for recognizing C, NG for recognizing T, NI for recognizing A, NN for recognizing G or A, NS for recognizing A, C, G or T, HG for recognizing T, IG for recognizing T, NK for recognizing G, HA for recognizing C, ND for recognizing C, HI for recognizing C, HN for recognizing G, NA for recognizing G, SN for recognizing G or A and YG for recognizing T, TL for recognizing A, VT for recognizing A or G and SW for recognizing A. More preferably, RVDs associated with recognition of the nucleotides C, T, A, G/A and G respectively are selected from the group consisting of NN or NK for recognizing G, HD for recognizing C, NG for recognizing T and NI for recognizing A, TL for recognizing A, VT for recognizing A or G and SW for recognizing A. In another embodiment, RVDs associated with recognition of the nucleotide C are selected from the group consisting of N* and RVDS associated with recognition of the nucleotide T are selected from the group consisting of N* and H*, where * denotes a gap in the repeat sequence that corresponds to a lack of amino acid residue at the second position of the RVD. In another embodiment, critical amino acids 12 and 13 can be mutated towards other amino acid residues in order to modulate their specificity towards nucleotides A, T, C and G and in particular to enhance this specificity. By other amino acid residues is intended any of the twenty natural amino acid residues or unnatural amino acids derivatives. All these RVDs can be used in addition to those with respect to the present invention, especially: NT, **, KG, NR, RN, HS, HH and/or HK.

As non limiting examples, chimeric MBBBD protein may be created by combining modules domains from E5AV36, E5AW43, E5AW45, EAW46, JCVI_A, JCVI_B and ECR81667 proteins with repeat domain of AvrBs3-like proteins, by combining modules domains from E5AV36, E5AW43, E5AW45, EAW46, JCVI_A, JCVI_B and ECR81667 proteins with the N- and C-terminal domains of AvrBs3-like proteins, by combining N and C-terminal domains of E5AV36, E5AW43, E5AW45, EAW46, JCVI_A, JCVI_B and ECR81667 proteins with repeat domain of AvrBs3-like proteins, by combining the N-terminal domain of AvrBs3-like proteins with modules domain and C-terminal from E5AV36, E5AW43, E5AW45, EAW46, JCVI_A, JCVI_B and ECR81667, by combining part of C-terminal domain of E5AV36, E5AW43, E5AW45, EAW46, JCVI_A, JCVI_B and ECR81667 with part of C-terminal domain of AvrBs3-like protein or other protein sequences as nuclear export signal sequence (see example 9, SEQ ID NO: 259 to SEQ ID NO. 261 and SEQ ID NO; 271 to 274), by combining part of N-terminal domain of E5AV36, E5AW43, E5AW45, EAW46, JCVI_A, JCVI_B and ECR81667 with part of N-terminal domain of AvrBs3-like protein, or by combining part of DNA binding modules of E5AV36, E5AW43, E5AW45, EAW46, JCVI_A, JCVI_B and ECR81667 with part of repeat domain of AvrBs3-like protein More generally, the protein domains from the E5AV36, E5AW43, E5AW45, E5AW46, JCVI_A, JCVI_B and ECR81667 proteins (module domain, N-terminal domain, C-terminal domain) may be used in combination with the complementary domains of classical TAL effectors. A most preferred chimeric protein comprises modules from E5AV36 with a N-terminal from AvrBs3 (see example 12, SEQ ID NO. 370 and SEQ ID NO. 372).

Polynucleotides

The invention also concerns the polynucleotides, in particular DNA or RNA encoding the polypeptides and proteins previously described. These polynucleotides may be included in vectors, more particularly plasmids or virus, in view of being expressed in prokaryotic or eukaryotic cells. The polynucleotides of SEQ ID NO.112 to 120 correspond to the sequences that have been identified according to the invention in the genomic databases. Polynucleotides according to the invention encompass polynucleotides having at least 80%, preferably at least 90%, more preferably at least 95 and even more preferably 99% identity with the above polynucleotide sequences.

The terms "vector" or "vectors" refer to a nucleic acid molecule capable of transporting another nucleic acid to which it has been linked. A "vector" in the present invention includes, but is not limited to, a viral vector, a plasmid, a RNA vector or a linear or circular DNA or RNA molecule which may consists of a chromosomal, non-chromosomal, semi-synthetic or synthetic nucleic acids. Preferred vectors are those capable of autonomous replication (episomal vector) and/or expression of nucleic acids to which they are linked (expression vectors). Large numbers of suitable vectors are known to those of skill in the art and commercially available. Viral vectors include retrovirus, adenovirus, parvovirus (e.g. adenoassociated viruses), coronavirus, negative strand RNA viruses such as orthomyxovirus (e.g., influenza virus), rhabdovirus (e.g., rabies and vesicular stomatitis virus), paramyxovirus (e.g. measles and Sendai), positive strand RNA viruses such as picornavirus and alphavirus, and double-stranded DNA viruses including adenovirus, herpesvirus (e.g., Herpes Simplex virus types 1 and 2, Epstein-Barr virus, cytomegalovirus), and poxvirus (e.g., vaccinia, fowlpox and canarypox). Other viruses include Norwalk virus, togavirus, flavivirus, reoviruses, papovavirus, hepadnavirus, and hepatitis virus, for example. Examples of retroviruses include: avian leukosis-sarcoma, mammalian C-type, B-type viruses, D type viruses, HTLV-BLV group, lentivirus, spumavirus (Coffin, J. M., Retroviridae: The viruses and their replication, In Fundamental Virology, Third Edition, B. N. Fields, et al., Eds., Lippincott-Raven Publishers, Philadelphia, 1996).

Preferred vectors are viral vectors, more particularly lentiviral vectors. "viral vector" refers to a nucleic acid construct which carries, and within certain embodiments, is capable of directing the expression of a nucleic acid molecule of interest. The lentiviral vector can include at least one transcriptional promoter/enhancer or locus defining element(s), or other elements which control gene expression by other means such as alternate splicing, nuclear RNA export, post-translational modification of messenger, or post-transcriptional modification of protein. Such vector constructs can also include a packaging signal, long terminal repeats (LTRs) or portion thereof, and positive and negative strand primer binding sites appropriate to the retrovirus used (if these are not already present in the retroviral vector). Optionally, the recombinant lentiviral vector may also include a signal which directs polyadenylation, selectable markers such as Neo, TK, hygromycin, phleomycin, histidinol, or DHFR, as well as one or more restriction sites and a translation termination sequence. By way of example, such vectors typically include a 5' LTR, a tRNA binding site, a packaging signal, an origin of second strand DNA synthesis, and a 3' LTR or a portion thereof. Viral vectors include retrovirus, adenovirus, parvovirus (e.g. adenoassociated viruses), coronavirus, negative strand RNA viruses such as orthomyxovirus (e.g., influenza virus), rhabdovirus (e.g., rabies and vesicular stomatitis virus), paramyxovirus (e.g. measles and Sendai), positive strand RNA viruses such as picornavirus and alphavirus, and double-stranded DNA viruses including adenovirus, herpesvirus (e.g., Herpes Simplex virus types 1 and 2, Epstein-Barr virus, cytomegalovirus), and poxvirus (e.g., vaccinia, fowlpox and canarypox). Other viruses include Norwalk virus, togavirus, flavivirus, reoviruses, papovavirus, hepadnavirus, and hepatitis virus, for example. Examples of retroviruses include: avian leukosis-sarcoma, mammalian C-type, B-type viruses, D type viruses, HTLV-BLV group, lentivirus, spumavirus (Coffin, J. M., Retroviridae: The viruses and their replication, In Fundamental Virology, Third Edition, B. N. Fields, et al., Eds., Lippincott-Raven Publishers, Philadelphia, 1996). More preferably, the present invention relates to a viral vector, preferably a lentiviral vector which comprises polynucleotide encoding MBBBD or MBBBD-fusion protein as described above. Any of these vectors can comprise one or more polynucleotide encoding MBBBD or MBBBD-fusion proteins. As non limiting example, one vector can comprise two sequences encoding two MBBBD monomers which can recognize different adjacent nucleic acid target sequences and the two protein domains function as subdomains that need to interact in order to process the genetic sequence. One vector can also comprise two sequences encoding two monomeric MBBBD which recognize and process two different nucleic acid target sequences.

"Viral particle" as utilized within the present invention refers to a virus which carries at least one gene of interest. The virus may also contain a selectable marker. For instance, HIV type 1 (HIV-1) based vector particles may be generated by co-expressing the virion packaging elements and the vector genome in a so-called producer cell, e.g. 293T human embryonic kidney cells. These cells may be transiently transfected with a number of plasmids. Typically from three to four plasmids are employed, but the number may be greater depending upon the degree to which the lentiviral components are broken up into separate units. Generally, one plasmid encodes the core and enzymatic components of the virion, derived from HIV-1. This plasmid is termed the packaging plasmid. Another plasmid encodes the envelope protein(s), most commonly the G protein of vesicular stomatitis virus (VSV G) because of its high stability and broad tropism. This plasmid may be termed the envelope expression plasmid. Yet another plasmid encodes the genome to be transferred to the target cell, that is, the vector itself, and is called the transfer vector. Recombinant viruses with titers of several millions of transducing units per milliliter (TU/ml) can be generated by this technique and variants thereof. After ultracentrifugation concentrated stocks of approximately $10^9$TU/ml can be obtained. The lentivirus is capable of reverse transcribing its genetic material into DNA and incorporating this genetic material into a host cell's DNA upon infection. Lentiviral vector particles may have a lentiviral envelope, a non-lentiviral envelope (e.g., an ampho or VSV-G envelope), or a chimeric envelope. The present invention relates to a viral, preferably a lentiviral particle which comprises polynucleotides encoding MBBBD or MBBBD-fusion protein as described above.

Methods for Processing the Genetic Material of a Cell

The present invention relates to a method of processing a nucleic acid target sequence of a cell, comprising: (a) providing a cell containing a target nucleic acid sequence; and (b) introducing into the cell a nucleic acid binding polypeptide such that said polypeptide processes the nucleic acid target sequence. Said nucleic acid binding polypeptide can be designed to recognize any suitable nucleic acid target sequence.

The term "processing" as used herein means that the sequence is considered modified simply by the binding of the polypeptide. Any nucleic acid target sequence can be processed by the present methods. For example, the nucleic acid target sequence can be chromosomal, mitochondrial or chloroplast sequences.

In another aspect, a method of processing the genetic material of a cell within or adjacent to a nucleic acid target sequence is provided by introducing into the cell fusion MBBBD polypeptides. Catalytic domain of the fusion protein of the present invention can be a transcription activator or repressor (i.e. a transcription regulator), or a protein that interacts with or modifies other proteins implicated in nucleic acid processing. Non-limiting examples of nucleic acid processing activities of said fusion polypeptides of the present invention include, for example, creating or modifying epigenetic regulatory elements, making site-specific insertions, deletions, or repairs in DNA, controlling gene expression, and modifying chromatin structure. Said nucleic acid processing activity can refer to a cleavage activity, either a cleavase activity either a nickase activity, more broadly a nuclease activity but also a polymerase activity, a kinase activity, a phosphatase activity, a methylase activity, a topoisomerase activity, an integrase activity, a transposase activity, a ligase, a helicase or recombinase activity as non-limiting examples.

By cell or cells is intended any prokaryotic or eukaryotic living cells, cell lines derived from these organisms for in vitro cultures, primary cells from animal or plant origin.

By "primary cell" or "primary cells" are intended cells taken directly from living tissue (i.e. biopsy material) and established for growth in vitro, that have undergone very few population doublings and are therefore more representative of the main functional components and characteristics of tissues from which they are derived from, in comparison to continuous tumorigenic or artificially immortalized cell lines. These cells thus represent a more valuable model to the in vivo state they refer to.

In the frame of the present invention, "eukaryotic cells" refer to a yeast, fungal, plant or animal cell or a cell line derived from the organisms listed below and established for in vitro culture. More preferably, the fungus is of the genus *Aspergillus, Penicillium, Acremonium, Trichoderma, Chrysoporium, Mortierella, Kluyveromyces* or *Pichia*. More preferably the plant is of the genus *Arabidospis, Nicotiana, Solanum, lactuca, Brassica, Glycine, Oryza, Asparagus, Pisum, Medicago, Zea, Hordeum, Secale, Triticum, Capsicum, Cucumis, Cucurbita, Citrullis, Citrus,* or *Sorghum.*

More preferably the animal cell is of the genus *Homo, Rattus, Mus, Sus, Bos, Danio, Canis, Felis, Equus, Salmo, Oncorhynchus, Gallus, Meleagris, Drosophila,* or *Caenorhabditis;*

In the present invention, the cell can be a plant cell, a mammalian cell, a fish cell, an insect cell or cell lines derived from these organisms for in vitro cultures or primary cells taken directly from living tissue and established for in vitro culture. As non-limiting examples, cell can be protoplasts obtained from plant organisms listed above. As non-limiting examples cell lines can be selected from the group consisting of CHO-K1 cells; HEK293 cells; Caco2 cells; U2-OS cells; NIH 3T3 cells; NSO cells; SP2 cells; CHO-S cells; DG44 cells; K-562 cells, U-937 cells; MRC5 cells; IMR90 cells; Jurkat cells; HepG2 cells; HeLa cells; HT-1080 cells; HCT-116 cells; Hu-h7 cells; Huvec cells; Molt 4 cells.

All these cell lines can be modified by the method of the present invention to provide cell line models to produce, express, quantify, detect, study a gene or a protein of interest; these models can also be used to screen biologically active molecules of interest in research and production and various fields such as chemical, biofuels, therapeutics and agronomy as non-limiting examples. Adoptive immunotherapy using genetically engineered T cells is a promising approach for the treatment of malignancies and infectious diseases. Most current approaches rely on gene transfer by random integration of an appropriate T Cell Receptor (TCR) or Chimeric Antigen Receptor (CAR). Targeted approach using rare-cutting endonucleases is an efficient and safe alternative method to transfer genes into T cells and generate genetically engineered T cells.

Methods of Genetic Engineering/Gene Editing/Mutagenesis

The present invention also relates to methods for use of said polypeptides polynucleotides and proteins previously described for various applications ranging from targeted nucleic acid cleavage to targeted gene regulation. In genome engineering experiments, the efficiency of nuclease fusion protein or chimeric protein as referred to in the present patent application, e.g. their ability to induce a desired event (Homologous gene targeting, targeted mutagenesis, sequence removal or excision) at a locus, depends on several parameters, including the specific activity of the nuclease, probably the accessibility of the target, and the efficacy and outcome of the repair pathway(s) resulting in the desired event (homologous repair for gene targeting, NHEJ pathways for targeted mutagenesis). The present invention more particularly relates to a method for modifying the genetic material of a cell within or adjacent to a nucleic acid target sequence. The double strand breaks caused by endonucleases are commonly repaired through non-homologous end joining (NHEJ). NHEJ comprises at least two different processes. Mechanisms involve rejoining of what remains of the two DNA ends through direct re-ligation (Critchlow and Jackson 1998) or via the so-called microhomology-mediated end joining (Ma, Kim et al. 2003). Repair via non-homologous end joining (NHEJ) often results in small insertions or deletions and can be used for the creation of specific gene knockouts. The present invention related to a method for modifying the genetic material of a cell within or adjacent to a nucleic acid target sequence by using nuclease MBBBD fusion protein or chimeric protein according to the invention that allows nucleic acid cleavage that will lead to the loss of genetic information and any NHEJ pathway will produce targeted mutagenesis. In a preferred embodiment, the present invention related to a method for modifying the genetic material of a cell within or adjacent to a nucleic acid target sequence by generating at least one nucleic acid cleavage and a loss of genetic information around said target nucleic acid sequence thus preventing any scarless re-ligation by NHEJ. Said modification may be a deletion of the genetic material, insertion of nucleotides in the genetic material or a combination of both deletion and insertion of nucleotides.

By "homologous" is intended a sequence with enough identity to another one to lead to homologous recombination between sequences, more particularly having at least 95% identity, preferably 97% identity and more preferably 99%.

The present invention also relates to a method for modifying target nucleic acid sequence further comprising the step of expressing an additional catalytic domain into a host cell. In a more preferred embodiment, the present invention relates to a method to increase mutagenesis wherein said additional catalytic domain is a DNA end-processing enzyme. Non limiting examples of DNA end-processing enzymes include 5-3' exonucleases, 3-5' exonucleases, 5-3' alkaline exonucleases, 5' flap endonucleases, helicases, hosphatase, hydrolases and template-independent DNA polymerases. Non limiting examples of, such catalytic domain comprise of a protein domain or catalytically active derivate of the protein domain selected from the group consisting of hExoI (EXO1_HUMAN), Yeast ExoI (EXO1_YEAST), *E. coli* ExoI, Human TREX2, Mouse TREX1, Human TREX1, Bovine TREX1, Rat TREX1, TdT (terminal deoxynucleotidyl transferase) Human DNA2, Yeast DNA2 (DNA2_YEAST). In a preferred embodiment, said additional catalytic domain has a 3'-5'-exonuclease activity, and in a more preferred embodiment, said additional catalytic domain has TREX exonuclease activity, more preferably TREX2 activity (WO2012058458). In another preferred embodiment, said catalytic domain is encoded by a single chain TREX polypeptide (WO2013009525). Said additional catalytic domain may be fused to a nuclease fusion protein or chimeric protein according to the invention optionally by a peptide linker.

Endonucleolytic breaks are known to stimulate the rate of homologous recombination. Therefore, in another preferred embodiment, the present invention relates to a method for inducing homologous gene targeting in the target nucleic acid sequence further comprising providing to the cell an exogenous nucleic acid comprising at least a sequence homologous to a portion of the target nucleic acid sequence, such that homologous recombination occurs between the target nucleic acid sequence and the exogenous nucleic acid.

Said exogenous nucleic acid usually comprises a sequence homologous to at least a portion of the target nucleic acid sequence, such that homologous recombination occurs between the target nucleic acid sequence and the exogenous nucleic acid. In particular embodiments, said exogenous nucleic acid comprises first and second portions which are homologous to region 5' and 3' of the target nucleic acid, respectively. Said exogenous nucleic acid in these embodiments also comprises a third portion positioned between the first and the second portion which comprises no homology with the regions 5' and 3' of the target nucleic acid sequence. Following cleavage of the target nucleic acid sequence, a homologous recombination event is stimulated between the genome containing the target nucleic acid sequence and the exogenous nucleic acid. Preferably, homologous sequences of at least 50 bp, preferably more than 100 bp and more preferably more than 200 bp are used within said donor matrix. Therefore, the exogenous nucleic acid is preferably from 200 bp to 6000 bp, more preferably from 1000 bp to 2000 bp. Indeed, shared nucleic acid homologies are located in regions flanking upstream and downstream the site of the break and the nucleic acid sequence to be introduced should be located between the two arms.

In particular embodiments, said exogenous nucleic acid can comprise a positive selection marker between the two homology arms and eventually a negative selection marker upstream of the first homology arm or downstream of the second homology arm. The marker(s) allow(s) the selection of the cells having inserted the sequence of interest by homologous recombination at the target site. Depending on the location of the targeted genome sequence wherein break event has occurred, such exogenous nucleic acid can be used to knock-out a gene, e.g. when exogenous nucleic acid is located within the open reading frame of said gene, or to introduce new sequences or genes of interest. Sequence insertions by using such exogenous nucleic acid can be used to modify a targeted existing gene, by correction or replacement of said gene (allele swap as a non-limiting example), or to up- or down-regulate the expression of the targeted gene (promoter swap as non-limiting example), said targeted gene correction or replacement.

The methods of the invention involve introducing a polynucleotide encoding MBBBD polypeptide into a cell. Methods for introducing a polynucleotide construct into bacteria, plants, fungi and animals are known in the art and including as non limiting examples stable transformation methods wherein the polynucleotide construct is integrated into the genome of the cell, transient transformation methods wherein the polynucleotide construct is not integrated into the genome of the cell and virus mediated methods. Said polynucleotides encoding MBBBD polypeptide may be introduced into a cell by for example, recombinant viral vectors (e.g. retroviruses, adenoviruses), liposomes and the like. For example, transient transformation methods include for example microinjection, electroporation, particle bombardment The MBBD polypeptide may be synthesized in situ in the cell as a result of the introduction of polynucleotide encoding polypeptide into the cell. Alternatively, the MBBBD polypeptide could be produced outside the cell and then introduced thereto.

In a preferred embodiment of the invention, the method for targeting genetic material of a cell comprises providing a cell comprising a nucleic acid target and introducing the polynucleotide encoding MBBBD or MBBBD fusion protein as described above into the cell via a viral particle, and expressing said polynucleotide within the cell. In particular, the viral particle comprises the polynucleotide and said polynucleotide is introduced into the cell by contacting said cell with the viral particle under condition that permits infection.

Engineered MBBBD polypeptides can be produced by rearranging modules thus allowing the generation of modular domain with novel target nucleic acid specificity. Each different MBBBD modules can be engineered following the recognition code according to the present invention. The present invention relates to a method to produce MBBBD polypeptides capable of binding to any desired nucleic acid target sequence by assembling the different engineered MBBBD modules in the appropriate order.

Method for Generating an Animal/a Plant

Animals may be generated by introducing MBBBD polypeptide into a cell or an embryo. In particular, the present invention relates to a method for generating an animal, comprising providing an eukaryotic cell comprising a nucleic acid target sequence into which it is desired to introduce a genetic modification; generating a cleavage within or adjacent to the nucleic acid target sequence by introducing a MBBBD polypeptide according to the present invention; and generating an animal from the cell or progeny thereof, in which cleavage has occurred. Typically, the embryo is a fertilized one cell stage embryo. Polynucleotides encoding said MBBBD polypeptides may be introduced into the cell by any of the methods known in the art including micro injection into the nucleus or cytoplasm of the embryo. In a particular embodiment, the method for generating an animal, further comprise introducing an exogenous nucleic acid as desired. Said exogenous nucleic acid comprises a sequence homologous to at least a portion of the nucleic acid target sequence, such that homologous recombination occurs between said exogenous nucleic acid and the nucleic acid target sequence in the cell or progeny thereof. The exogenous nucleic acid can include for example a nucleic acid sequence that disrupts a gene after homologous recombination, a nucleic acid sequence that replaces a gene after homologous recombination, a nucleic acid sequence that introduces a mutation into a gene after homologous recombination or a nucleic acid sequence that introduce a regulatory site after homologous recombination. The embryos are then cultures to develop an animal. In one aspect of the invention, an animal in which at least a nucleic acid target sequence of interest has been engineered is provided. For example, an engineered gene may become inactivated such that it is not transcribed or properly translated, or an alternate form of the gene is expressed. The animal may be homozygous or heterozygous for the engineered gene.

The present invention also related to a method for generating a plant comprising providing a plant cell comprising a nucleic acid target sequence into which it is desired to introduce a genetic modification; generating a cleavage within or adjacent to the nucleic acid target sequence by introducing a MBBD polypeptide according to the present invention; and generating a plant from the cell or progeny thereof, in which cleavage has occurred. Progeny includes descendants of a particular plant or plant line. In a particular embodiment, the method for generating a plant, further comprise introducing an exogenous nucleic acid as desired. Said exogenous nucleic acid comprises a sequence homologous to at least a portion of the nucleic acid target sequence, such that homologous recombination occurs between said exogenous nucleic acid and the nucleic acid target sequence in the cell or progeny thereof. Plant cells produced using methods can be grown to generate plants having in their genome a modified nucleic acid target sequence. Seeds from such plants can be used to generate plants having a phenotype such as, for example, an altered growth characteristic, altered appearance, or altered compositions with respect to unmodified plants.

The polypeptides of the invention are useful to engineer genomes and to reprogram cells, especially iPS cells and ES cells.

Therapeutic Applications

From the above, the polypeptides according to the invention can be used as a medicament, especially for modulating, activating or inhibiting gene transcription, at the promoter level or through their catalytic domains.

Fusion proteins composed of a binding domain according to the invention and of a catalytic domain with nuclease activity can be used for the treatment of a genetic disease to correct a mutation at a specific locus or to inactivate a gene the expression of which is deleterious. Such proteins can also be used to genetically modify iPS or primary cells, for instance T-cells, in view of injected such cells into a patient for treating a disease or infection. Such cell therapy schemes are more particularly developed for treating cancer, viral infection such as caused by CMV or HIV or self-immune diseases.

Having generally described this invention, a further understanding can be obtained by reference to certain specific examples, which are provided herein for purposes of illustration only, and are not intended to be limiting unless otherwise specified.

EXAMPLES

Example 1

Nuclease Activity of BurrH_36 Based Constructs

BurrH_36 (SEQ ID NO.2) was chosen as a starting polypeptide to create new specific nuclease. The DNA coding for the N-terminal (SEQ ID NO.7) and C-terminal (SEQ ID NO.64) domains was synthesized according to the human genetic code and cloned in the pUC57 plasmid, by Genecust. In addition, the two domains were separated by a small DNA sequence containing two BsmBI sites allowing further cloning of the DNA coding for the DNA binding array, a Nuclear Localization Sequence (NLS) and HA tag were added in front of the N-terminal domain and short sequences were added between the different pieces for cloning purpose or to create linkers at the protein level, leading to BurrH_36 scaffold pCLS17028 (SEQ ID NO.121). In parallel, the DNA coding for the DNA binding array (BurrH_RVD_array1, SEQ ID NO.122) was synthesized according to the human genetic code and cloned in the pUC57 plasmid, by Genecust, leading to pCLS17030. The BurrH_36 scaffold was then sublconed, from pCLS17028, into a yeast expression vector containing a FokI catalytic head (SEQ ID NO.123) preceded by a short linker sequence, using NcoI and BamHI, leading to pCLS17419 (SEQ ID NO.124). The DNA binding array insert was then subcloned, from pCLS17030 into pCLS17419 using the two BsmBI sites, leading to pCLS17421 (SEQ ID NO.125). All molecular biology steps were done according to standard procedures.

All the yeast target reporter plasmids containing the DNA target collection sequences (SEQ ID NO.126 to 138, Table 1) were constructed as previously described (International PCT Applications WO 2004/067736 and in (Epinat, Arnould et al. 2003; Chames, Epinat et al. 2005; Arnould, Chames et al. 2006; Smith, Grizot et al. 2006). The BurrH_36 based nucleases were tested at 37° C. and 30° C. in yeast SSA assay as previously described in WO 2004/067736 and in (Epinat, Arnould et al. 2003; Chames, Epinat et al. 2005; Arnould, Chames et al. 2006; Smith, Grizot et al. 2006), as pseudo-palindromic sequences (two identical recognition sequences are placed facing each other on both DNA strands) on the target collection. BurrH_36 based nucleases cleavage activity levels on the complete collection of targets in yeast are shown in Table 2.

TABLE 1

List of all pseudo-palindromic sequences targets (two identical recognition sequences are placed facing each other on both DNA strands - minuscule letters represent spacers) used in yeast SSA assay. The control target represents a target having an irrelevant sequence.

| Name | SEQ ID | Sequences |
|---|---|---|
| BURRH_v01 | NO. 126 | TAAGAGAAGCAAAGACGTTACtagcatgaaggtaccGTAACGTCTTTGCTTCTCTTA |
| BURRH_v02 | NO. 127 | AAAGAGAAGCAAAGACGTTACtagcatgaaggtaccGTAACGTCTTTGCTTCTCTTT |
| BURRH_v03 | NO. 128 | CAAGAGAAGCAAAGACGTTACtagcatgaaggtaccGTAACGTCTTTGCTTCTCTTG |
| BURRH_v04 | NO. 129 | GAAGAGAAGCAAAGACGTTACtagcatgaaggtaccGTAACGTCTTTGCTTCTCTTC |
| BURRH_v05 | NO. 130 | TAAGCGAAGCAACTACGTTACtagcatgaaggtaccGTAACGTAGTTGCTTCGCTTA |
| BURRH_v06 | NO. 131 | AAAGCGAAGCAACTACGTTACtagcatgaaggtaccGTAACGTAGTTGCTTCGCTTT |
| BURRH_v07 | NO. 132 | CAAGCGAAGCAACTACGTTACtagcatgaaggtaccGTAACGTAGTTGCTTCGCTTG |
| BURRH_v08 | NO. 133 | GAAGCGAAGCAACTACGTTACtagcatgaaggtaccGTAACGTAGTTGCTTCGCTTC |
| BURRH_v09 | NO. 134 | TAAGAGAAGCAAATACGTTACtagcatgaaggtaccGTAACGTATTTGCTTCTCTTA |
| BURRH_v10 | NO. 135 | AAAGAGAAGCAAATACGTTACtagcatgaaggtaccGTAACGTATTTGCTTCTCTTT |
| BURRH_v11 | NO. 136 | CAAGAGAAGCAAATACGTTACtagcatgaaggtaccGTAACGTATTTGCTTCTCTTG |

TABLE 1-continued

List of all pseudo-palindromic sequences targets (two identical
recognition sequences are placed facing each other on both DNA
strands - minuscule letters represent spacers) used in yeast
SSA assay. The control target represents a target having an
irrelevant sequence.

| Name | SEQ ID | Sequences |
|---|---|---|
| BURRH_v12 | NO. 137 | GAAGAGAAGCAAATACGTTACtagcatgaaggtaccGTAACGTATTTGCTTCTCTTC |
| CTRL target | NO. 138 | TTTATATAAACCTAACCCTCTtagcatgaaggtaccAGAGGGTTAGGTTTATATACA |

FIG. 8 shows the correspondence between the different modules of BurrH_36 with respect to the different DNA targets. Target A is common to the target sequences BURRH_v01, BURRH_v02, BURRH_v03 et BURRH_v04 presented in Table 1, Target B is common to the target sequences BURRH_v05, BURRH_v06, BURRH_v07 et BURRH_v08. Target C is common to the target sequences BURRH_v09, BURRH_v10, BURRH_v11 et BURRH_v12.

TABLE 2

Activity of BurrH_36 derived nuclease on pseudo-palindromic
sequences targets (two identical recognition sequences are
placed facing each other on both DNA strands) in
yeast SSA assay at 37° C. "−" indicates that no cleavage activity
was detected and +++ a high cleavage activity.

| DNA Target | pCLS17421 cleavage activity |
|---|---|
| BURRH_v01 | +++ |
| BURRH_v02 | +++ |
| BURRH_v03 | +++ |
| BURRH_v04 | +++ |
| BURRH_v12 | +++ |
| BURRH_v09 | +++ |
| BURRH_v10 | +++ |
| BURRH_v11 | +++ |
| BURRH_v05 | +++ |
| BURRH_v06 | +++ |
| BURRH_v07 | +++ |
| BURRH_v08 | +++ |
| CTRL | − |

It is observed, when comparing activity data obtained on BURRH_v01 to v04 targets (SEQ ID: 126 to 129) or BURRH_v05 to v08 targets (SEQ ID: 130 to 133) or BURRH_v09 to v12 targets (SEQ ID: 134 to 137), that the nature (A, T, C or G) of the first base (so-called base 0 in the context of TALE-Nuclease) has here no impact on cleavage activity, which is not the case with classical AvrBS3 based TALE-Nuclease design. TALE-Nuclease have a strong preference for a thymine (T). The so-called T0 requirement thus does seem to exist for such EAV36_BURRH based fusion proteins.

It also observed, when comparing activity data obtained on BURRH_v01, v05 and v09 targets (SEQ ID: 126, 130 and 134) that modules containing NT at positions 12 and 13 result into a similar activity on targets containing either an adenine (A) or a thymine (T) and that NR results into a similar activity on targets containing either a guanine (G) or a thymine (T).

Example 2

Nuclease Activity of BurrH_36 Based Constructs in Function of Target Nucleotides in Position 0, −1 and −2

Nuclease activity of BurrH_36 based nuclease encoded in plasmid pCLS17421 (SEQ ID NO. 125) was monitored on a set of 21 targets differing only by their nucleotidic sequences in position 0, −1 and −2 (SEQ ID NO. 139 to 159, see Table 3) as described in Example 1. Similar activities were obtained on all targets (Table 4) indicating an absence of specific sequence requirement for position 0, −1 and −2.

Example 3

Nuclease Activity of Engineered BurrH_36 Based Constructs Containing 18 DNA Binding Modules To create shorter array of natural modules of EAV36, the original array of 20 modules has been shrunk in 18 modules to target AvrBs3. A 18 module array has been designed following this proceeding:
1. From 1st to 12th the wild type order and nature of the modules has been preserved.
2. In position 13th has been inserted the 15th module followed by the 16th and 17th modules.
3. Then the 16th module has been preserved and the 19th and 20th modules have been added in position 17th and 18th.

The BurrH_36 scaffold in a yeast expression vector, described in example 1 (pCLS17419 (SEQ ID NO. 124)) was chosen as receiving scaffold plasmid. The DNA binding array insert was then subcloned, from pCLS18120 (SEQ ID NO. 160) into pCLS17419 using the two BsmBI sites, leading to pCLS18473 (SEQ ID NO. 161). All molecular biology steps were done according to standard procedures. The sequences of the DNA binding array insert are represented in Table 5 below.

TABLE 3

List of all pseudo-palindromic (two identical recognition sequences are placed facing each other on both DNA strands) sequences targets, with various nucleotides in position 0, -1 and -2 used in the yeast SSA assay.

| Name | SEQ ID NO | Sequence |
|---|---|---|
| BurrH_36_v13 | 139 | ATTAAGAGAAGCAAAGACGTTACtagcatgaaggtaccGTAACGTCTTTGCTTCTCTTAAT |
| BurrH_36_v14 | 140 | GTTAAGAGAAGCAAAGACGTTACtagcatgaaggtaccGTAACGTCITTGCTTCTCTTAAC |
| BurrH_36_v15 | 141 | CTTAAGAGAAGCAAAGACGTTACtagcatgaaggtaccGTAACGTCTTTGCTTCTCTTAAG |
| BurrH_36_v16 | 142 | TATAAGAGAAGCAAAGACGTTACtagcatgaaggtaccGTAACGTCTTTGCTTCTCTTATA |
| BurrH_36_v17 | 143 | TCTAAGAGAAGCAAAGACGTTACtagcatgaaggtaccGTAACGTCTTTGCTTCTCTTAGA |
| BurrH_36_v18 | 144 | TGTAAGAGAAGCAAAGACGTTACtagcatgaaggtaccGTAACGTCTTTGCTTCTCTTACA |
| BurrH_36_v19 | 145 | ATAAAGAGAAGCAAAGACGTTACtagcatgaaggtaccGTAACGTCTTTGCTTCTCTTTAT |
| BurrH_36_v20 | 146 | GTAAAGAGAAGCAAAGACGTTACtagcatgaaggtaccGTAACGTCTTTGCTTCTCTTTAC |
| BurrH_36_v21 | 147 | CTAAAGAGAAGCAAAGACGTTACtagcatgaaggtaccGTAACGTCTTTGCTTCTCTTTAG |
| BurrH_36_v22 | 148 | TAAAAGAGAAGCAAAGACGTTACtagcatgaaggtaccGTAACGTCTTTGCTTCTCTTTTA |
| BurrH_36_v23 | 149 | TCAAAGAGAAGCAAAGACGTTACtagcatgaaggtaccGTAACGTCTTTGCTTCTCTTTGA |
| BurrH_36_v24 | 150 | TGAAAGAGAAGCAAAGACGTTACtagcatgaaggtaccGTAACGTCTTTGCTTCTCTTTCA |
| BurrH_36_v25 | 151 | ATCAAGAGAAGCAAAGACGTTACtagcatgaaggtaccGTAACGTCTTTGCTTCTCTTGAT |
| BurrH_36_v26 | 152 | GTCAAGAGAAGCAAAGACGTTACtagcatgaaggtaccGTAACGTCTTTGCTTCTCTTGAC |
| BurrH_36_v27 | 153 | CTCAAGAGAAGCAAAGACGTTACtagcatgaaggtaccGTAACGTCTTTGCTTCTCTTGAG |
| BurrH_36_v28 | 154 | TACAAGAGAAGCAAAGACGTTACtagcatgaaggtaccGTAACGTCTTTGCTTCTCTTGTA |
| BurrH_36_v29 | 155 | TCCAAGAGAAGCAAAGACGTTACtagcatgaaggtaccGTAACGTCTTTGCTTCTCTTGGA |
| BurrH_36_v30 | 156 | TGCAAGAGAAGCAAAGACGTTACtagcatgaaggtaccGTAACGTCTTTGCTTCTCTTGCA |
| BurrH_36_v33 | 157 | CTGAAGAGAAGCAAAGACGTTACtagcatgaaggtaccGTAACGTCTTTGCTTCTCTTCAG |
| BurrH_36_v34 | 158 | TAGAAGAGAAGCAAAGACGTTACtagcatgaaggtaccGTAACGTCTTTGCTTCTCTTCTA |
| BurrH_36_v35 | 159 | TCGAAGAGAAGCAAAGACGTTACtagcatgaaggtaccGTAACGTCTTTGCTTCTCTTCGA |

TABLE 4

Activity of BurrH_36 derived nuclease on pseudo-palindromic sequences targets (Table 3) in yeast SSA assay at 37° C. +++ indicates a high activity.

| DNA Target | pCLS17421 cleavage activity |
|---|---|
| BurrH_36_v13 | +++ |
| BurrH_36_v14 | +++ |
| BurrH_36_v15 | +++ |
| BurrH_36_v16 | +++ |
| BurrH_36_v17 | +++ |
| BurrH_36_v18 | +++ |
| BurrH_36_v19 | +++ |
| BurrH_36_v20 | +++ |
| BurrH_36_v21 | +++ |
| BurrH_36_v22 | +++ |
| BurrH_36_v23 | +++ |
| BurrH_36_v24 | +++ |
| BurrH_36_v25 | +++ |
| BurrH_36_v26 | +++ |
| BurrH_36_v27 | +++ |
| BurrH_36_v28 | +++ |
| BurrH_36_v29 | +++ |
| BurrH_36_v30 | +++ |
| BurrH_36_v33 | +++ |
| BurrH_36_v34 | +++ |
| BurrH_36_v35 | +++ |

TABLE 5

Sequences of the module domains of BurrH_36 based constructs containing 18 DNA binding modules

| Module domains | Amino acids sequences | SEQ ID NO. |
|---|---|---|
| BurrH_36 1 | FSQSD IVKIA GXXGG AQALQ AVLDL ESMLG KRG | 162 |
| BurrH_36 2 | FSRDD IAKMA GXXGG AQTLQ AVLDL ESAFR ERG | 163 |
| BurrH_36 3 | FSQAD IVKIA GXXGG AQALY SVLDV EPTLG KRG | 164 |
| BurrH_36 4 | FSRAD IVKIA GXXGG AQALH TVLDL EPALG KRG | 165 |
| BurrH_36 5 | FSRID IVKIA AXXGG AQALH AVLDL GPTLR ECG | 166 |
| BurrH_36 6 | FSQAT IAKIA GXXGG AQALQ MVLDL GPALG KRG | 167 |
| BurrH_36 7 | FSQAT IAKIA GXXGG AQALQ TVLDL EPALC ERG | 168 |
| BurrH_36 8 | FSQAT IAKMA GXXGG AQALQ TVLDL EPALR KRD | 169 |
| BurrH_36 9 | FRQAD IIKIA GXXGG AQALQ AVIEH GPTLR QHG | 170 |
| BurrH_36 10 | FNLAD IVKMA GXXGG AQALQ AVLDL KPVLD EHG | 171 |
| BurrH_36 11 | FSQPD IVKMA GXXGG AQALQ AVLSL GPALR ERG | 172 |
| BurrH_36 12 | FSQPD IVKIA GXXGG AQALQ AVLDL ELTLV EHG | 173 |
| BurrH_36 15 | FSQAD IVKIA GXXGG TQALH AVLDL ERMLG ERG | 176 |
| BurrH_36 16 | FSRAD IVNVA GXXGG AQALK AVLEH EATLN ERG | 177 |
| BurrH_36 17 | FSRAD IVKIA GXXGG AQALK AVLEH EATLD ERG | 178 |
| BurrH_36 16 | FSRAD IVNVA GXXGG AQALK AVLEH EATLN ERG | 177 |
| BurrH_36 19 | FNLTD IVEMA AXXGG AQALK AVLEH GPTLR QRG | 180 |
| BurrH_36 20 | LSLID IVEIA GXXGG AQALK AVLKY GPVLM QAG | 181 |

The yeast target reporter plasmids containing the DNA target sequences (SEQ ID NO. 182 to 217 shown in Table 6) were constructed as previously described (International PCT Applications WO 2004/067736 and in (Epinat, Arnould et al. 2003; Chames, Epinat et al. 2005; Arnould, Chames et al. 2006; Smith, Grizot et al. 2006). The BurrH_36 based nucleases were tested on the target collection at 37° C. in yeast SSA assay as previously described (WO 2004/067736 and (Epinat, Arnould et al. 2003; Chames, Epinat et al. 2005; Arnould, Chames et al. 2006; Smith, Grizot et al. 2006). Targets are designed as pseudo-palindromic sequences (two identical recognition sequences are placed facing each other on both DNA strands). BurrH_36 based nucleases cleavage activity levels on the complete collection of targets in yeast are shown on Table 7.

TABLE 6

List of all pseudo-palindromic (two identical AvBrs3 recognition sequences are placed facing each other on both DNA strands) sequences targets, with various spacer length (ranging from 5 to 40 bp) used in yeast SSA. Minuscule letters represent spacers.

| Name | SEQ ID | Sequence |
|---|---|---|
| Avr05 | 182 | TATATAAACCTAACCCTCTaggtaAGAGGGTTAGGTTTATATA |
| Avr06 | 183 | TATATAAACCTAACCCTCTaaggtaAGAGGGTTAGGTTTATATA |
| Avr07 | 184 | TATATAAACCTAACCCTCTaaggtacAGAGGGTTAGGTTTATATA |

TABLE 6-continued

List of all pseudo-palindromic (two identical AvBrs3 recognition sequences are placed facing each other on both DNA strands) sequences targets, with various spacer length (ranging from 5 to 40 bp) used in yeast SSA. Minuscule letters represent spacers.

| Name | SEQ ID | Sequence |
|------|--------|----------|
| Avr08 | 185 | TATATAAACCTAACCCTCTgaaggtacAGAGGGTTAGGTTTATATA |
| Avr09 | 186 | TATATAAACCTAACCCTCTgaaggtaccAGAGGGTTAGGTTTATATA |
| Avr10 | 187 | TATATAAACCTAACCCTCTtgaaggtaccAGAGGGTTAGGTTTATATA |
| Avr11 | 188 | TATATAAACCTAACCCTCTtgaaggtacctAGAGGGTTAGGTTTATATA |
| Avr12 | 189 | TATATAAACCTAACCCTCTatgaaggtacctAGAGGGTTAGGTTTATATA |
| Avr13 | 190 | TATATAAACCTAACCCTCTatgaaggtaccttAGAGGGTTAGGTTTATATA |
| Avr14 | 191 | TATATAAACCTAACCCTCTcatgaaggtaccttAGAGGGTTAGGTTTATATA |
| Avr15 | 192 | TATATAAACCTAACCCTCTtagcatgaaggtaccAGAGGGTTAGGTTTATATA |
| Avr16 | 193 | TATATAAACCTAACCCTCTgcatgaaggtaccttgAGAGGGTTAGGTTTATATA |
| Avr17 | 194 | TATATAAACCTAACCCTCTgcatgaaggtaccttgtAGAGGGTTAGGTTTATATA |
| Avr18 | 195 | TATATAAACCTAACCCTCTagcatgaaggtaccttgtAGAGGGTTAGGTTTATATA |
| Avr19 | 196 | TATATAAACCTAACCCTCTagcatgaaggtaccttgtcAGAGGGTTAGGTTTATATA |
| Avr20 | 197 | TATATAAACCTAACCCTCTtagcatgaaggtaccttgtcAGAGGGTTAGGTTTATATA |
| Avr21 | 198 | TATATAAACCTAACCCTCTtagcatgaaggtaccttgtcgAGAGGGTTAGGTTTATATA |
| Avr22 | 199 | TATATAAACCTAACCCTCTtagcatgaaggtaccttgtcgtAGAGGGTTAGGTTTATATA |
| Avr23 | 200 | TATATAAACCTAACCCTCTCTagcatgaaggtaccttgtcgtAGAGGGTTAGGTTTATATA |
| Avr24 | 201 | TATATAAACCTAACCCTCTCTagcatgaaggtaccttgtcgttAGAGGGTTAGGTTTATATA |
| Avr25 | 202 | TATATAAACCTAACCCTCTACTagcatgaaggtaccttgtcgttAGAGGGTTAGGTTTATATA |
| Avr26 | 203 | TATATAAACCTAACCCTCTACTagcatgaaggtaccttgtcgttgAGAGGGTTAGGTTTATATA |
| Avr27 | 204 | TATATAAACCTAACCCTCTCACTagcatgaaggtaccttgtcgttgAGAGGGTTAGGTTTATATA |
| Avr28 | 205 | TATATAAACCTAACCCTCTCACTagcatgaaggtaccttgtcgttgaAGAGGGTTAGGTTTATATA |
| Avr29 | 206 | TATATAAACCTAACCCTCTCCACTagcatgaaggtaccttgtcgttgaAGAGGGTTAGGTTTATATA |
| Avr30 | 207 | TATATAAACCTAACCCTCTCCACTagcatgaaggtaccttgtcgttgatAGAGGGTTAGGTTTATATA |
| Avr31 | 208 | TATATAAACCTAACCCTCTACCACTagcatgaaggtaccttgtcgttgatAGAGGGTTAGGTTTATATA |
| Avr32 | 209 | TATATAAACCTAACCCTCTACCACTagcatgaaggtaccttgtcgttgattAGAGGGTTAGGTTTATATA |
| Avr33 | 210 | TATATAAACCTAACCCTCTGACCACTagcatgaaggtaccttgtcgttgattAGAGGGTTAGGTTTATATA |
| Avr34 | 211 | TATATAAACCTAACCCTCTGACCACTagcatgaaggtaccttgttgattcAGAGGGTTAGGTTTATATA |
| Avr35 | 212 | TATATAAACCTAACCCTCTTGACCACTagcatgaaggtaccttgtcgttgattcAGAGGGTTAGGTTTATATA |
| Avr36 | 213 | TATATAAACCTAACCCTCTTGACCACTagcatgaaggtaccttgtcgttgattcaAGAGGGTTAGGTTTATATA |
| Avr37 | 214 | TATATAAACCTAACCCTCTCTGACCACTagcatgaaggtaccttgtcgttgattcaAGAGGGTTAGGTTTATATA |
| Avr38 | 215 | TATATAAACCTAACCCTCTCTGACCACTagcatgaaggtaccttgtcgttgattcAGAGAGGGTTAGGTTTATATA |
| Avr39 | 216 | TATATAAACCTAACCCTCTTCTGACCACTagcatgaaggtaccttgtcgttgattcAGAGAGGGTTAGGTTTATATA |

TABLE 7

Activity of BurrH_36 derived nuclease on pseudo-palindromic sequences targets listed in Table 6 in yeast SSA at 37° C. − indicates that no activity was detected, + indicates a low activity, ++ a medium activity and +++ a high activity.

| DNA Target | pCLS18473 cleavage activity |
| --- | --- |
| Avr05 | − |
| Avr06 | − |
| Avr07 | − |
| Avr08 | + |
| Avr09 | − |
| Avr10 | − |
| Avr11 | − |
| Avr12 | +++ |
| Avr13 | +++ |
| Avr14 | +++ |
| Avr15 | +++ |
| Avr16 | +++ |
| Avr17 | +++ |
| Avr18 | +++ |
| Avr19 | +++ |
| Avr20 | +++ |
| Avr21 | +++ |
| Avr22 | +++ |
| Avr23 | +++ |
| Avr24 | +++ |
| Avr25 | +++ |
| Avr26 | +++ |
| Avr27 | +++ |
| Avr28 | ++ |
| Avr29 | ++ |
| Avr30 | ++ |
| Avr31 | ++ |
| Avr32 | ++ |
| Avr33 | +++ |
| Avr34 | +++ |
| Avr35 | +++ |
| Avr36 | +++ |
| Avr37 | ++ |
| Avr38 | + |
| Avr39 | + |
| Avr40 | + |

Example 4

Nuclease Activity of Engineered BurrH_36 Based Constructs Containing 16 DNA Binding Modules To create shorter array of natural modules of EAV36, the original array of 20 modules has been shrunk in 16 modules to target RAGT2. Analogously to 18 module array, a 16 module array has been designed following this proceeding:

1. From 1st to 12th the wt order and nature of the modules has been preserved.
2. In position 13th has been inserted the 15th module followed by the 16th module.
3. Then 19th and 20th modules have been added in position 15th and 16th.

The BurrH_36 scaffold in a yeast expression vector, described in example 1 (pCLS17419 (SEQ ID NO. 124)) was chosen as receiving scaffold plasmid. The DNA binding array inserts were then subcloned, from pCLS18123 and pCLS18127 (SEQ ID NO. 218 and SEQ ID NO. 219) into pCLS17419 using the two BsmBI sites, leading to respectively pCLS18476 (SEQ ID NO. 220) and pCLS18480 (SEQ ID NO. 221). All molecular biology steps were done according to standard procedures. The sequences of the DNA binding array insert are represented in Table 8 below.

TABLE 8

Sequences of the module domains of BurrH_36 based constructs containing 16 DNA binding modules

| Module domains | Amino acids sequences | SEQ ID NO. |
| --- | --- | --- |
| BurrH_36 1 | FSQSD IVKIA GXXGG AQALQ AVLDL ESMLG KRG | 162 |
| BurrH_36 2 | FSRDD IAKMA GXXGG AQTLQ AVLDL ESAFR ERG | 163 |
| BurrH_36 3 | FSQAD IVKIA GXXGG AQALY SVLDV EPTLG KRG | 164 |
| BurrH_36 4 | FSRAD IVKIA GXXGG AQALH TVLDL EPALG KRG | 165 |
| BurrH_36 5 | FSRID IVKIA AXXGG AQALH AVLDL GPTLR ECG | 166 |
| BurrH_36 6 | FSQAT IAKIA GXXGG AQALQ MVLDL GPALG KRG | 167 |
| BurrH_36 7 | FSQAT IAKIA GXXGG AQALQ TVLDL EPALC ERG | 168 |
| BurrH_36 8 | FSQAT IAKMA GXXGG AQALQ TVLDL EPALR KRD | 169 |
| BurrH_36 9 | FRQAD IIKIA GXXGG AQALQ AVLEH GPTLR QHG | 170 |
| BurrH_36 10 | FNLAD IVKMA GXXGG AQALQ AVLDL KPVLD EHG | 171 |
| BurrH_36 11 | FSQPD IVKMA GXXGG AQALQ AVLSL GPALR ERG | 172 |
| BurrH_36 12 | FSQPD IVKIA GXXGG AQALQ AVLDL ELTLV EHG | 173 |
| BurrH_36 15 | FSQAD IVKIA GXXGG TQALH AVLDL ERMLG ERG | 176 |

TABLE 8-continued

Sequences of the module domains of BurrH_36 based constructs containing 16 DNA binding modules

| Module domains | Amino acids sequences | SEQ ID NO. |
|---|---|---|
| BurrH_36 16 | FSRAD IVNVA GXXGG AQALK AVLEH EATLN ERG | 177 |
| BurrH_36 19 | FNLTD IVEMA AXXGG AQALK AVLEH GPTLR QRG | 180 |
| BurrH_36 20 | LSLID IVEIA GXXGG AQALK AVLKY GPVLM QAG | 181 |

The yeast target reporter plasmids containing the RAGT2.4 and RAGT2.3 DNA target sequences (SEQ ID NO. 222 and SEQ ID NO. 223, Table 9) were constructed as previously described (International PCT Applications WO 2004/067736 and in (Epinat, Arnould et al. 2003; Chames, Epinat et al. 2005; Arnould, Chames et al. 2006; Smith, Grizot et al. 2006). The BurrH_36 based nucleases were tested on their respective target at 37° C. in the yeast SSA assay as previously described. Targets are designed as pseudo-palindromic sequences (two identical recognition sequences are placed facing each other on both DNA strands). BurrH_36 based nucleases cleavage activity levels on their respective targets in yeast are shown in Table 10.

TABLE 9

List of the 2 pseudo-palindromic (two identical recognition sequences are placed facing each other on both DNA strands) sequences targets, used in the yeast and mammalian SSA assays. Minuscule letters represent spacers.

| Name | Sequence | SEQ ID NO. |
|---|---|---|
| RAGT2.4 | TGTTTATGGTTACTTATatgtgtgtaacaggtATAAGTAACCATAAACA | 222 |
| RAGT2.3 | TATATTTAAGCACTTATatgtgtgtaacaggtATAAGTGCTTAAATATA | 223 |

TABLE 10

Activity of BurrH_36 derived nuclease on pseudo-palindromic sequences targets listed in Table 9 in yeast SSA assay at 37° C. "−"indicates that no activity was detected and +++ a high activity.

| DNA Target | pCLS18476 cleavage activity | pCLS18480 cleavage activity |
|---|---|---|
| RAGT2.4 | +++ | − |
| RAGT2.3 | − | +++ |

Example 5

Nuclease Activity of Engineered BurrH_36 Based Constructs Containing 16 Engineered Alternative DNA Binding Modules To test the possibility to use only one module to build a new engineered array of 16 modules, consensus sequences derived from the alignment of only the first 5 modules of E5AV36 or of all the E5AV36 modules have been determined.

The BurrH_36 scaffold in a yeast expression vector, described in example 1 (pCLS17419 (SEQ ID NO. 124)) was chosen as receiving scaffold plasmid. The DNA binding array inserts were then subcloned, from pCLS18124 to pCLS18126 (SEQ ID NO. 224 to SEQ ID NO. 226) into pCLS17419 using the two BsmBI sites, leading to pCLS18477 to pCLS18479 respectively (SEQ ID NO. 227 to SEQ ID NO. 229). All molecular biology steps were done according to standard procedures. The sequences of DNA binding array insert of pCLS18477 to pCLS18479 are represented in Tables 11 to 13 respectively.

TABLE 11

Sequences of the 16 module domains of pCLS18477 construct derived from the alignmentof the first 5 modules of E5AV36.

| Module domains | pCLS18477 DNA binding array | SEQ ID NO. |
|---|---|---|
| consensus first 5 | FSRAD IVKIA GXXGG AQALQ AVLDL ESTLG KRG | 230 |
| consensus first 5 | FSRAD IVKIA GXXGG AQALQ AVLDL ESTLG KRG | 230 |
| consensus first 5 | FSRAD IVKIA GXXGG AQALQ AVLDL ESTLG KRG | 230 |

TABLE 11-continued

Sequences of the 16 module domains of pCLS18477 construct derived from the alignment of the first 5 modules of E5AV36.

| Module domains | pCLS18477 DNA binding array | SEQ ID NO. |
|---|---|---|
| consensus first 5 | FSRAD IVKIA GXXGG AQALQ AVLDL ESTLG KRG | 230 |
| consensus first 5 | FSRAD IVKIA GXXGG AQALQ AVLDL ESTLG KRG | 230 |
| consensus first 5 | FSRAD IVKIA GXXGG AQALQ AVLDL ESTLG KRG | 230 |
| consensus first 5 | FSRAD IVKIA GXXGG AQALQ AVLDL ESTLG KRG | 230 |
| consensus first 5 | FSRAD IVKIA GXXGG AQALQ AVLDL ESTLG KRG | 230 |
| consensus first 5 | FSRAD IVKIA GXXGG AQALQ AVLDL ESTLG KRG | 230 |
| consensus first 5 | FSRAD IVKIA GXXGG AQALQ AVLDL ESTLG KRG | 230 |
| consensus first 5 | FSRAD IVKIA GXXGG AQALQ AVLDL ESTLG KRG | 230 |
| consensus first 5 | FSRAD IVKIA GXXGG AQALQ AVLDL ESTLG KRG | 230 |
| consensus first 5 | FSRAD IVKIA GXXGG AQALQ AVLDL ESTLG KRG | 230 |
| consensus first 5 | FSRAD IVKIA GXXGG AQALQ AVLDL ESTLG KRG | 230 |
| consensus first 5 | FSRAD IVKIA GXXGG AQALQ AVLDL ESTLG KRG | 230 |
| BurrH_36 20 | LSLID IVEIA GXXGG AQALK AVLKY GPVLM QAG | 181 |

TABLE 12

Sequences of the 16 module domains of pCLS18478 construct derived from the alignment of all the E5AV36 modules.

| Module domains | pCLS18478 DNA binding array | SEQ ID NO. |
|---|---|---|
| consensus all | FSQAD IVKIA GXXGG AQALQ AVLDL EPTLR ERG | 231 |
| consensus all | FSQAD IVKIA GXXGG AQALQ AVLDL EPTLR ERG | 231 |
| consensus all | FSQAD IVKIA GXXGG AQALQ AVLDL EPTLR ERG | 231 |
| consensus all | FSQAD IVKIA GXXGG AQALQ AVLDL EPTLR ERG | 231 |
| consensus all | FSQAD IVKIA GXXGG AQALQ AVLDL EPTLR ERG | 231 |
| consensus all | FSQAD IVKIA GXXGG AQALQ AVLDL EPTLR ERG | 231 |
| consensus all | FSQAD IVKIA GXXGG AQALQ AVLDL EPTLR ERG | 231 |
| consensus all | FSQAD IVKIA GXXGG AQALQ AVLDL EPTLR ERG | 231 |
| consensus all | FSQAD IVKIA GXXGG AQALQ AVLDL EPTLR ERG | 231 |
| consensus all | FSQAD IVKIA GXXGG AQALQ AVLDL EPTLR ERG | 231 |
| consensus all | FSQAD IVKIA GXXGG AQALQ AVLDL EPTLR ERG | 231 |
| consensus all | FSQAD IVKIA GXXGG AQALQ AVLDL EPTLR ERG | 231 |
| consensus all | FSQAD IVKIA GXXGG AQALQ AVLDL EPTLR ERG | 231 |
| consensus all | FSQAD IVKIA GXXGG AQALQ AVLDL EPTLR ERG | 231 |
| consensus all | FSQAD IVKIA GXXGG AQALQ AVLDL EPTLR ERG | 231 |
| BurrH_36 20 | LSLID IVEIA GXXGG AQALK AVLKY GPVLM QAG | 181 |

TABLE 13

Sequences of the 16 module domains of pCLS18479 construct derived from the alignment of all the E5AV36 modules

| Module domains | pCLS18479 DNA binding array | SEQ ID NO. |
| --- | --- | --- |
| BurrH_36 1 | FSQSD IVKIA GXXGG AQALQ AVLDL ESMLG KRG | 162 |
| consensus all | FSQAD IVKIA GXXGG AQALQ AVLDL EPTLR ERG | 231 |
| consensus all | FSQAD IVKIA GXXGG AQALQ AVLDL EPTLR ERG | 231 |
| consensus all | FSQAD IVKIA GXXGG AQALQ AVLDL EPTLR ERG | 231 |
| consensus all | FSQAD IVKIA GXXGG AQALQ AVLDL EPTLR ERG | 231 |
| consensus all | FSQAD IVKIA GXXGG AQALQ AVLDL EPTLR ERG | 231 |
| consensus all | FSQAD IVKIA GXXGG AQALQ AVLDL EPTLR ERG | 231 |
| consensus all | FSQAD IVKIA GXXGG AQALQ AVLDL EPTLR ERG | 231 |
| consensus all | FSQAD IVKIA GXXGG AQALQ AVLDL EPTLR ERG | 231 |
| consensus all | FSQAD IVKIA GXXGG AQALQ AVLDL EPTLR ERG | 231 |
| consensus all | FSQAD IVKIA GXXGG AQALQ AVLDL EPTLR ERG | 231 |
| consensus all | FSQAD IVKIA GXXGG AQALQ AVLDL EPTLR ERG | 231 |
| consensus all | FSQAD IVKIA GXXGG AQALQ AVLDL EPTLR ERG | 231 |
| consensus all | FSQAD IVKIA GXXGG AQALQ AVLDL EPTLR ERG | 231 |
| BurrH_36 19 | FNLTD IVEMA AXXGG AQALK AVLEH GPTLR QRG | 180 |
| BurrH_36 20 | LSLID IVEIA GXXGG AQALK AVLKY GPVLM QAG | 181 |

The yeast target reporter plasmids containing the DNA target sequence (SEQ ID NO. 222, Table 9) were constructed as previously described. The BurrH_36 based nucleases were tested on their respective target at 37° C. in the yeast SSA assay as previously described. Targets are designed as pseudo-palindromic sequences (two identical recognition sequences are placed facing each other on both DNA strands). BurrH_36 based nucleases cleavage activity levels on their respective targets in yeast are shown in Table 14.

TABLE 14

Activity of BurrH_36 derived nuclease on one of the pseudo-palindromic sequences targets listed in Table 9 in yeast SSA assay at 37° C. + indicates a low activity, ++ a medium activity and +++ a high activity.

| DNA target | pCLS18476 cleavage activity | pCLS18477 cleavage activity | pCLS18478 cleavage activity | pCLS18479 cleavage activity |
| --- | --- | --- | --- | --- |
| RAGT2.4 | +++ | + | ++ | ++ |

Example 6

Nuclease Activity of Engineered BurrH_36 Based Constructs in Mammalian Cells (CHO-K1) on an Extrachromosomal Target To create the first BurrH_36 scaffold, DNA encoding burrH_36 based nuclease scaffold was extracted from yeast plasmid pCLS17028 using NcoI and BamHI. The DNA insert was further ligated in NcoI/BamHI opened mammalian expression plasmids leading to BurrH_36 backbone plasmid pCLS18645 (SEQ ID NO. 232). This mammalian expression plasmid encodes a Nuclear Localization Sequence (NLS) followed by HA tag, the BurrH_36 backbone and a FokI catalytic head under an EF1a promoter.

To create the second BurrH_36 scaffold, DNA encoding burrH_36 based nuclease scaffold was extracted from yeast plasmid pCLS17028 (SEQ ID NO. 121) using EcoRV and BamHI. The final BurrH_36 backbone plasmid pCLS18646 (SEQ ID NO. 233) was obtained by ligation of 3 fragments: the NcoI/BamHI opened mammalian expression plasmids, the EcoRV/BamHI digested burrH_36 based nuclease scaffold and a NcoI/EcoRV digested fragment encoding a Nuclear Localization Sequence (NLS) followed by S tag (SEQ ID NO. 234). This mammalian expression plasmid encodes a Nuclear Localization Sequence (NLS) followed by S tag, the BurrH_36 backbone and a FokI catalytic head under an EF1a promoter.

The DNA binding array inserts were then subcloned, from pCLS18123 and pCLS18127 (SEQ ID NO. 218 and SEQ ID NO.219) into pCLS18646 and pCLS18645 respectively (SEQ ID NO. 233 and SEQ ID NO. 232) using the two BsmBI sites, leading to respectively pCLS19041 (SEQ ID NO. 235) and pCLS19042 (SEQ ID NO. 236).

All the mammalian target reporter plasmids containing the DNA target sequences were constructed using standard gateway Gateway protocol (INVITROGEN) into a CHO reporter vector (Grizot, Epinat et al.; Arnould, Chames et al. 2006). Activity of BurrH_36 based nucleases were tested in our extrachromosomal assay in mammalian cells (CHO K1) as homodimer (two identical recognition sequences are placed facing each other on both DNA strands) on the sequence target RAGT2.4 and RAGT2.3 (SEQ ID NO. 222 and SEQ ID NO. 223, Table 9). For this assay, CHO K1 cells were transfected in a 96-well plate format with 75 ng of target vector and an increasing quantity of each variant DNA from 0.02 to 25 ng, in the presence of PolyFect reagent (1 μL per well). The total amount of transfected DNA was completed to 100 ng (target DNA, variant DNA, carrier DNA) using an empty vector. 72 hours after transfection, culture medium was removed and 150p1 of lysis/revelation buffer for β-galactosidase liquid assay was added. After incubation at 37° C., OD was measured at 420 nm. The entire process is performed on an automated Velocity11 BioCel platform (Grizot, Epinat et al.).

Figure 9:
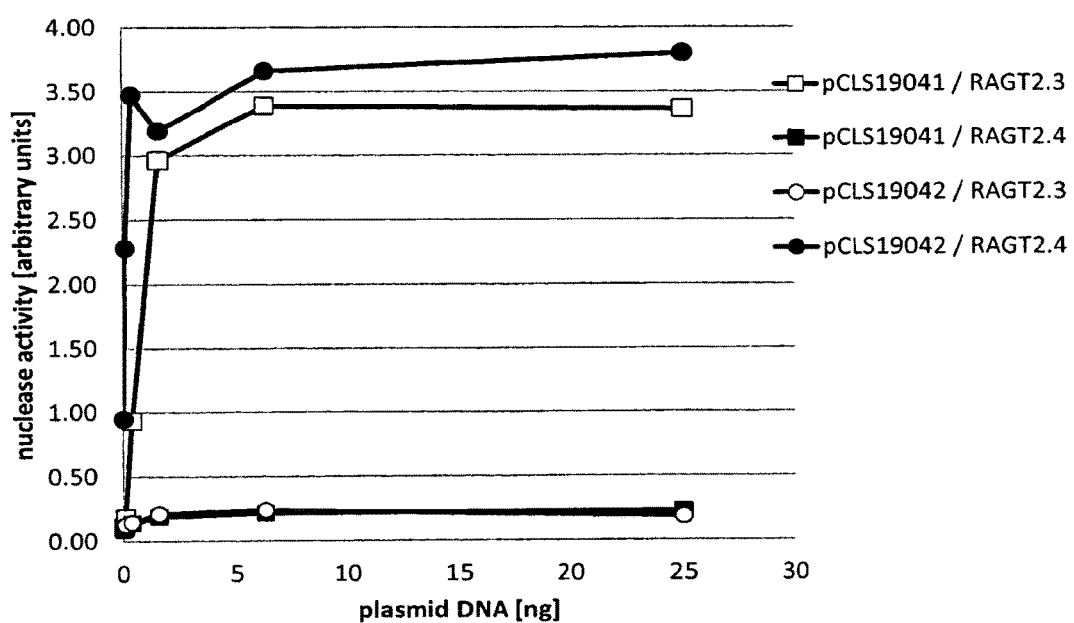
FIG. 9: Activity of BurrH_36 derived nuclease on pseudopalindromic RAGT2.3 and RAGT2.4 target sequences listed in Table 9 in our mammalian SSA assay.

Nuclease cleavage activity levels on their respective targets in mammalian cells are shown in FIG. 9.

Example 7a

Nuclease Activity of Engineered BurrH_36 Based Constructs Containing 18 DNA Binding Modules in Mammalian Cells (293H) at an Endogenous Locus BurrH_36 target endogenous locus To monitor the ability of burrH_36 based nucleases to induce Targeted Mutagenesis (TM) at burrH_36 target endogenous loci (SEQ ID NO.237), the DNA binding array inserts pCLS19087 and pCLS20851 (SEQ ID NO. 238 and SEQ ID NO. 239) were subcloned in mammalian expression plasmids pCLS18645 and pCLS18646 (SEQ ID NO. 232 and SEQ ID NO. 233) as described in example 6 leading to pCLS19638 and pCLS19679 respectively (SEQ ID NO. 240 and SEQ ID NO. 241). 293H cells were first plated at a density of $1.2 \times 10^6$ cells per 10 cm dish. The next day (day 0) cells were transfected with a total amount of 5 μg of pCLS19638 and pCLS19679 (SEQ ID NO. 240 and SEQ ID NO. 241) or control empty vector using Lipofectamine 2000 transfection reagent (Life Technologies) according to the manufacturer's protocol. Three days post-transfection (day 3), genomic DNA was extracted and the locus of interest was amplified with locus primers 1 and 2 (SEQ ID NO. 242 and SEQ ID NO. 243). Primer 1 containing an adaptor sequences required for deep sequencing method using the GS Junior 454 (Roche). Examples of targeted mutagenesis (indels) at the desired locus (wt; SEQ ID NO. 237) are provided in FIG. 10.

CAPSN1 endogenous locus

To monitor the ability of burrH_36 based nucleases construct to induce Targeted Mutagenesis (TM) at CAPSN1 endogenous locus (SEQ ID NO. 244), the DNA binding array inserts pCLS20311 and pCLS20312 (SEQ ID NO. 245 and SEQ ID NO. 246) were subcloned in mammalian expression plasmids pCLS18645 and pCLS18646 (SEQ ID NO. 232 and SEQ ID NO. 233) as described in example 6 leading to pCLS21603 and pCLS21607 respectively (SEQ ID NO. 247 and SEQ ID NO. 248). 293H cells were first plated at a density of $1.2 \times 10^6$ cells per 10 cm dish. The next day (day 0) cells were transfected with a total amount of 5 μg of pCLS21603 and pCLS21607 (SEQ ID NO. 247 and SEQ ID NO. 248) or control empty vector using Lipofectamine 2000 transfection reagent (Life Technologies) according to the manufacturer's protocol. Three days post-transfection (day 3), genomic DNA was extracted and the locus of interest was amplified with locus primers 1 and 2 (SEQ ID NO. 242 and SEQ ID NO. 243). Primer 1 containing an adaptor sequences required for deep sequencing method using the GS Junior 454 (Roche). Examples of targeted mutagenesis (indels) at the desired locus (wt; SEQ ID NO. 244) are provided in FIG. 11.

Example 7b

Nuclease Activity of Engineered BurrH_36 Based Constructs Containing 20 DNA Binding Modules in Mammalian Cells (293H) at an Endogenous Locus To monitor the ability of burrH_36 based nucleases comprising 20 DNA binding modules (SEQ ID NO: 162 to SEQ ID NO: 181) to induce Targeted Mutagenesis (TM) at their endogenous loci (SEQ ID NO.249), the DNA binding array inserts pCLS20313 and pCLS20314 (SEQ ID NO. 250 and SEQ ID NO. 251) were subcloned in mammalian expression plasmids pCLS18645 and pCLS18646 (SEQ ID NO. 232 and SEQ ID NO. 233) as described in example 6 leading to pCLS21604 and pCLS21608 respectively (SEQ ID NO. 252 and SEQ ID NO. 253). 293H cells were first plated at a density of $1.2 \times 10^6$ cells per 10 cm dish. The next day (day 0) cells were transfected with a total amount of 5 μg of pCLS21604 and pCLS21608 (SEQ ID NO. 252 and SEQ ID NO. 253) or control empty vector using Lipofectamine 2000 transfection reagent (Life Technologies) according to the manufacturer's protocol. Three days post-transfection (day 3), genomic DNA was extracted and the locus of interest was amplified with locus primers 1 and 2 (SEQ ID NO. 242 and SEQ ID NO. 243). Primer 1 containing an adaptor sequences required for deep sequencing method using the GS Junior 454 (Roche). Examples of targeted mutagenesis (indels) at the desired locus (wt; SEQ ID NO. 357) are provided in FIG. 12.

Example 8

Figure 13:
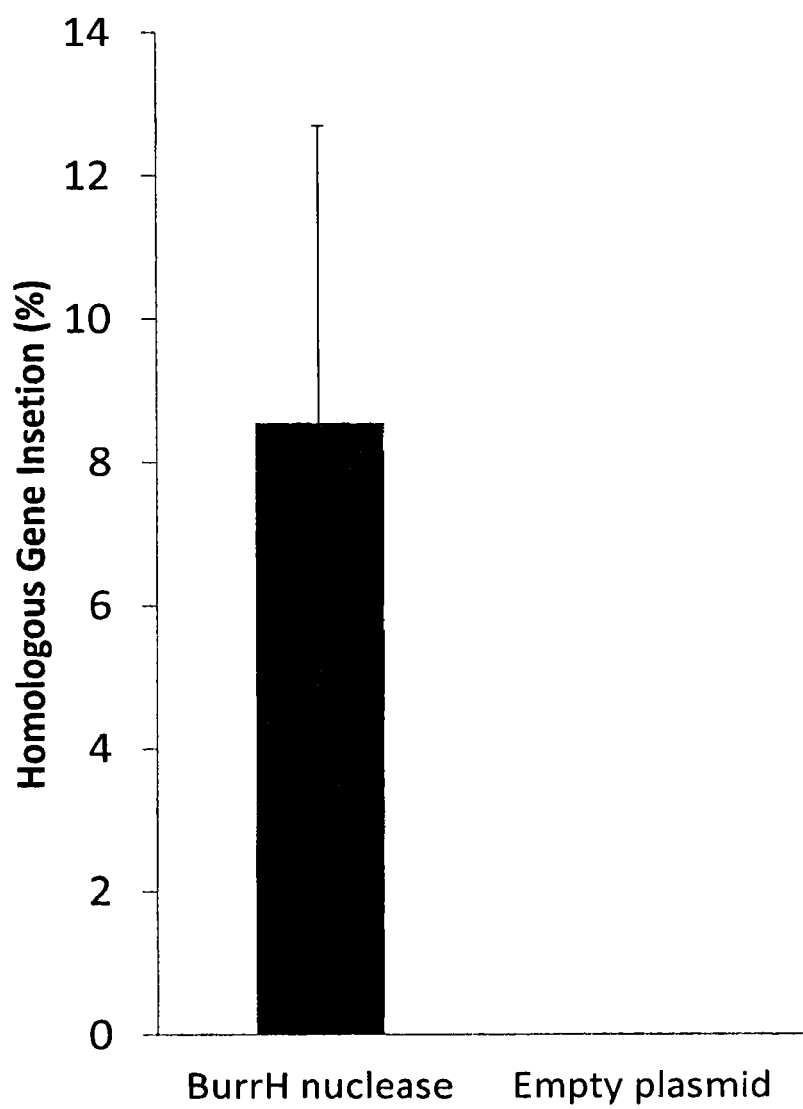
FIG. 13: Targeted Gene Insertion (TGI) frequency determined at the CAPNSI locus in the presence or absence (empty plasmid) of the nuclease.

Homologous Gene Insertion Induced by Engineered BurrH_36 Based Constructs (20 DNA Binding Modules) in Mammalian Cells (293H) at Endogenous Locus To monitor the ability of burrH_36 based nucleases containing 20 DNA binding modules to induce knock-in at their endogenous loci (SEQ ID NO. 249), the DNA binding array inserts pCLS20313 and pCLS20314 (SEQ ID NO. 250 and SEQ ID NO. 251) were subcloned in mammalian expression plasmids pCLS18645 and pCLS18646 (SEQ ID NO. 232 and SEQ ID NO. 233) as described in example 6 leading to pCLS21604 and pCLS21608 respectively (SEQ ID NO. 252 and SEQ ID NO. 253). 293H cells were first plated at a density of $1.2 \times 10^6$ cells per 10 cm dish. The next day (day 0) cells were transfected with a total amount of 2.5 μg of pCLS21604 (SEQ ID NO. 252), 2.5 μg pCLS21608 (SEQ ID NO. 253), 5 μg of insertion matrix pCLS9893 (SEQ ID NO. 254), 250 ng of GFP expression vector and completed to 15 μg with a control empty vector using Lipofectamine 2000 transfection reagent (Life Technologies) according to the manufacturer's protocol. Three days post-transfection (day 3), cells were re-seeded in three 96 well plates at 10 cells per well and let at 37° C. for 15 more days 5% $CO_2$ in DMEM complete medium. Homologous Gene Insertion positive clones were monitored 18 days post transfection by PCRs using the Herculase II Fusion kit (Invitrogen) with oligonucleotides KI-1F, KI1-R, KI2-F and KI2-R (SEQ ID NO. 255, 256, 257 and 258 respectively). Targeted Gene Insertion (TGI) frequency at the desired locus (wt; SEQ ID NO. 249) is provided in FIG. 13.

Example 9

Modification of the C-terminal Domain

Activity in Yeast

BurrH_36 (SEQ ID NO.2) was chosen as a starting polypeptide to create new specific nuclease. Three hybrid C-terminal domains were constructed by the fusion of the C-terminal domain of BurrH36 to different fragments of C-terminal domain of AvrBs3 (SEQ ID NO. 259 to SEQ ID NO. 261). The DNA coding for hybrid C-terminal domains (SEQ ID NO. 262 to 264) was synthesized according to the human genetic code and cloned in the pUC57 plasmid. Inserts were obtained by standard molecular biology techniques (PmlI and BamHI restriction) and further subcloned in pCLS17419 (SEQ ID NO.124), leading to pCLS19785, pCLS19787 and pCLS19788 (SEQ ID NO. 265 to 267). The DNA binding array insert was then subcloned from pCLS18120 (SEQ ID NO. 160) as described in example 3, into pCLS19785 and pCLS19787 to pCLS19788 leading to pCLS19815 to pCLS19817 (SEQ ID NO. 268 to 269). All molecular biology steps were done according to standard procedures.

The BurrH_36 based nucleases were tested, as described in example 3, on the Avr15 target (SEQ ID NO. 192 shown in Table 6) at 37° C. in yeast SSA assay as previously described (WO 2004/067736 and (Epinat, Arnould et al. 2003; Chames, Epinat et al. 2005; Arnould, Chames et al. 2006; Smith, Grizot et al. 2006). BurrH_36 based nucleases cleavage activity levels in yeast are shown on Table 15.

TABLE 15

Activity of BurrH_36 derived nuclease on AVR15 sequences targets in yeast SSA assay at 37° C. +++ indicates a high activity.

| DNA target | pCLS19815 cleavage activity | pCLS19816 cleavage activity | pCLS19817 cleavage activity |
|---|---|---|---|
| Avr15 | +++ | +++ | ++++ |

Activity in CHO

BurrH_36 (SEQ ID NO.2) was chosen as a starting polypeptide to create new specific nuclease. Two hybrid C-terminal domains were constructed by the fusion of C-terminal domain of burrH36 to nuclear export signal sequence to regulate the quantity of burrH 36 in the nucleus (SEQ ID NO. 271 and SEQ ID NO. 272). The DNA coding for hybrid C-terminal domains (SEQ ID NO. 273 and SEQ ID NO. 274) was synthesized according to the human genetic code and cloned in the pUC57 plasmid. Inserts were obtained by standard molecular biology techniques (XmaI and BamHI restriction) and further subcloned in pCLS18645 and pCLS18646 (SEQ ID NO. 232 and SEQ ID NO. 233) leading to pCLS22405, pCLS22406, pCLS22420 and pCLS22421 respectively (SEQ ID NO. 275 to SEQ ID NO. 278). A DNA binding array insert was then subcloned from pCLS19087 (SEQ ID NO. 238) as described in example 3, into pCLS22405 and pCLS22406 leading to pCLS23511 and pCLS23513 (SEQ ID NO. 280 to 281). A DNA binding array insert was then subcloned from pCLS19088 (SEQ ID NO. 279) as described in example 3, into pCLS22420 and pCLS22421 leading to pCLS23531 and pCLS23533 (SEQ ID NO. 282 and SEQ ID NO. 283). All molecular biology steps were done according to standard procedures.

Figure 14:
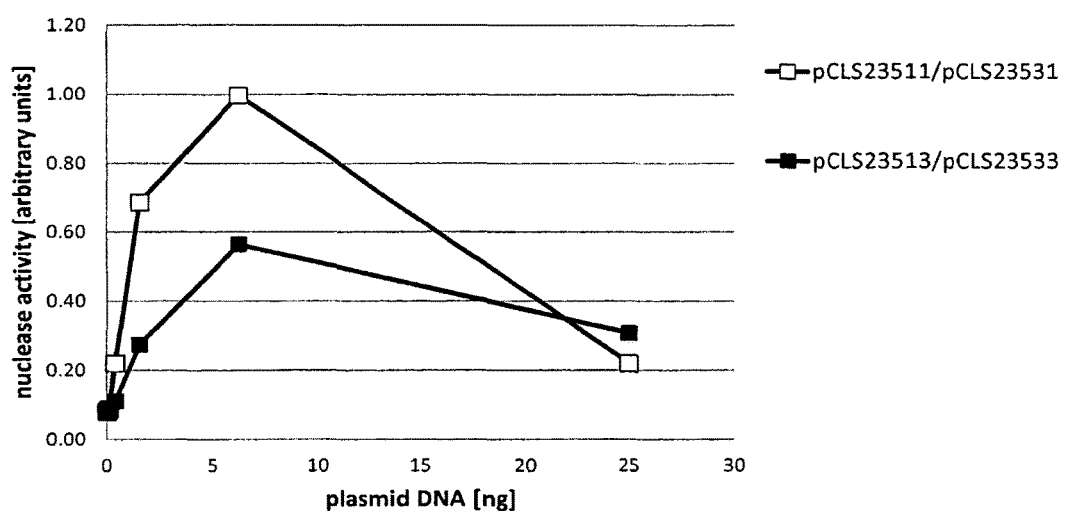
FIG. 14: Activity of BurrH_36 derived nuclease on AVR15 sequences targets in CHO SSA assay.

Nuclease pairs, respectively pCLS23511/pCLS23531 and pCLS23513/pCLS23533 were tested in CHO as described in example 6 on the CAPT1 target (SEQ ID NO. 284), constructed as reported in example 6. Nuclease cleavage activity levels on their respective targets in mammalian cells are shown in FIG. 14.

Example 10

Figure 15:
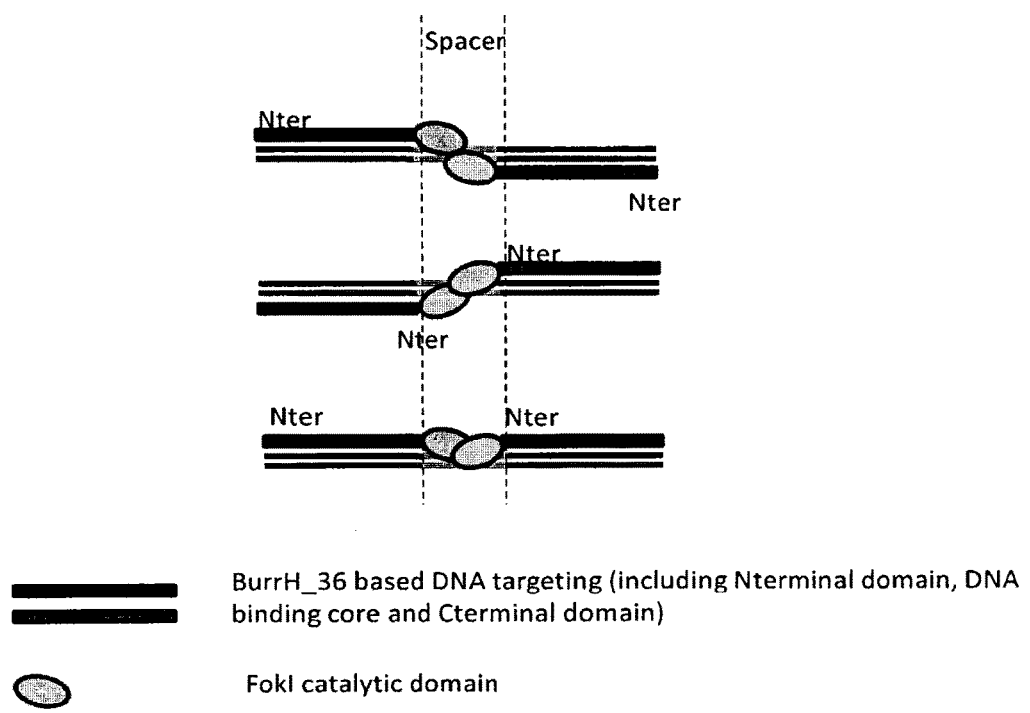
FIG. 15: Graphical representation of possible architectures. (a) two BurrH_based monomers facing each other on both DNA strands with FokI catalytic domain fused at the C-terminus (C/C). (b) two BurrH_based monomers facing each other on both DNA strands with FokI catalytic domain fused at the N-terminus (N/N). (c) two BurrH_based monomers following each other on one DNA strand with FokI catalytic domain fused at the C-terminus for the first and N-terminus for the second (C/N).

N-Terminal Fusion of the FokI Nuclease Catalytic Domain and Activity of the N/N and C/N Architectures All the BurrH_36 nuclease described in the preceding examples comprise the catalytic domain FokI fused to the C-terminal domain of the DNA binding domain. The two others architectures of burrH_36 nuclease (see FIG. 15) were evaluate for their ability to cleave DNA target. BurrH_36 nuclease with N-terminal fusion of FokI nuclease catalytic domain was engineered and activity of the N/N and C/N architectures was determined. BurrH_36 (SEQ ID NO.2) was chosen as a starting polypeptide to create new specific burrH_36 nuclease with N-terminal fusion of FokI nuclease catalytic domain. The DNA coding for the FokI catalytic domain, BurrH_36 N-terminal (SEQ ID NO.7) and hybrid C-terminal domains (SEQ ID NO. 262) was synthesized according to the human genetic code and cloned in the pUC57 plasmid, by Genecust (SEQ ID NO. 285). In addition, the two N-terminal and C-terminal domains were separated by a small DNA sequence containing two BsmBI sites allowing further cloning of the DNA coding for the DNA binding array, a Nuclear Localization Sequence (NLS) was added at the C-terminal domain and short sequences were added between the different pieces for cloning purpose or to create linkers at the protein level, leading to BurrH_36 scaffold pCLS21170 (SEQ ID NO. 286). The DNA binding array insert targeted AvBrs3 sequence was then subcloned from pCLS18120 (SEQ ID NO. 160) as described in example 3, into pCLS21170, leading to pCLS21226 (SEQ ID NO. 287).

In parallel the BurrH_Scaffold described in example 1 pCLS17419 (SEQ ID NO. 124)) with C-terminal fusion of the FokI catalytic domain was subcloned in a yeast plasmid containing a kanamycin resistance gene, leading to pCLS20474 (SEQ ID NO. 288). The DNA binding array insert targeted RAGT2.4 sequence was then subcloned from pCLS18123 (SEQ ID NO. 218) as described in example 4, into pCLS20474, leading to pCLS23060 (SEQ ID NO. 289). All molecular biology steps were done according to standard procedures.

The yeast target reporter plasmid collections containing, either two AvrBs3 (SEQ ID NO. 290) sequence facing each other in the 5'/5' (or N/N) orientation on both DNA strand (SEQ ID NO. 291 to SEQ ID NO. 321, Table 16) or a single RAGT2.4 DNA target sequences (SEQ ID NO. 322) preceding a single AvrBs3 (SEQ ID NO. 290) target sequence on the same DNA strand (SEQ ID NO. 323 to SEQ ID NO. 358, Table 17) were constructed as previously described (International PCT Applications WO 2004/067736 and in (Epinat, Arnould et al. 2003; Chames, Epinat et al. 2005; Arnould, Chames et al. 2006; Smith, Grizot et al. 2006). The BurrH_36 based nucleases were tested on the target collections 37° C. in the yeast SSA assay as previously described by cotransformation of both pCLS23060 (SEQ ID NO. 289) and pCLS21226 (SEQ ID NO. 287).

TABLE 16

List of all pseudo-palindromic (two identical recognition sequences are placed facing each other in the 5'/5' (or N/N) orientation on both DNA strands) sequences targets, with various spacer sizes used in our yeast SSA assay previously described (International PCT Applications WO 2004/067736 and in (Epinat, Arnould et al. 2003; Chames, Epinat et al. 2005; Arnould, Chames et al. 2006; Smith, Grizot et al. 2006).

| Name | SEQ ID | Sequence |
|---|---|---|
| NfusAvr05b | 291 | AGAGGGTTAGGTTTATATAaggtaTATATAAACCTAACCCTCT |
| NfusAvr06b | 292 | AGAGGGTTAGGTTTATATAaaggtaTATATAAACCTAACCCTCT |
| NfusAvr07b | 293 | AGAGGGTTAGGTTTATATAaaggtacTATATAAACCTAACCCTCT |
| NfusAvr08b | 294 | AGAGGGTTAGGTTTATATAgaaggtacTATATAAACCTAACCCTCT |
| NfusAvr09b | 295 | AGAGGGTTAGGTTTATATAgaaggtaccTATATAAACCTAACCCTCT |
| NfusAvr10b | 296 | AGAGGGTTAGGTTTATATAtgaaggtaccTATATAAACCTAACCCICT |
| NfusAvr11b | 297 | AGAGGGTTAGGTTTATATAtgaaggtacctTATATAAACCTAACCCTCT |
| NfusAvr12b | 298 | AGAGGGTTAGGTTTATATAatgaaggtacctTATATAAACCTAACCCTCT |
| NfusAvr13b | 299 | AGAGGGTTAGGTTTATATAatgaaggtaccttTATATAAACCTAACCCTCT |
| NfusAvr14b | 300 | AGAGGGTTAGGTTTATATAcatgaaggtaccttTATATAAACCTAACCCTCT |
| NfusAvr15b | 301 | AGAGGGTTAGGTTTATATAcatgaaggtaccttgTATATAAACCTAACCCTCT |
| NfusAvr16b | 302 | AGAGGETTAGGTTTATATAgcatgaaggtaccttgTATATAAACCTAACCCTCT |
| NfusAvr17b | 303 | AGAGGGTTAGGTTTATATAgcatgaaggtaccttgtTATATAAACCTAACCCTCT |
| NfusAvr18b | 304 | AGAGGGTTAGGTTTATATAagcatgaaggtaccttgtTATATAAACCTAACCCTCT |
| NfusAvr19b | 305 | AGAGGGTTAGGTTTATATAagcatgaaggtaccttgtcTATATAAACCTAACCCTCT |
| NfusAvr20b | 306 | AGAGGGTTAGGTTTATATAtagcatgaaggtaccttgtcTATATAAACCTAACCCTCT |
| NfusAvr21b | 307 | AGAGGGTTAGGTTTATATAtagcatgaaggtaccttgtcgTATATAAACCTAACCCTCT |
| NfusAvr22b | 308 | AGAGGGTTAGGTTTATATAtagcatgaaggtaccttgtcgtTATATAAACCTAACCCTCT |
| NfusAvr23b | 309 | AGAGGGTTAGGTTTATATActagcatgaaggtaccttgtcgtTATATAAACCTAACCCTCT |
| NfusAvr24b | 310 | AGAGGGTTAGGTTTATATActagcatgaaggtaccttgtcgttTATATAAACCTAACCCTCT |
| NfusAvr25b | 311 | AGAGGGTTAGGTTTATATAactagcatgaaggtaccttgtcgttTATATAAACCTAACCCTCT |
| NfusAvr26b | 312 | AGAGGGTTAGGTTTATATAactagcatgaaggtaccttgtcgttgTATATAAACCTAACCCTCT |
| NfusAvr27b | 313 | AGAGGGITAGGTTTATATAcactagcatgaaggtaccttgtcgttgTATATAAACCTAACCCTCT |
| NfusAvr28b | 314 | AGAGGGTTAGGTTTATATAcactagcatgaaggtaccttgtcgttgaTATATAAACCTAACCCTCT |
| NfusAvr29b | 315 | AGAGGGTTAGGTTTATATAccactagcatgaaggtaccttgtcgttgaTATATAAACCTAACCCTCT |
| NfusAvr30b | 316 | AGAGGGTTAGGTTTATATAccactagcatgaaggtaccttgtcgttgatTATATAAACCTAACCCTCT |
| NfusAvr31b | 317 | AGAGGGTTAGGTTTATATAaccactagcatgaaggtaccttgtcgttgatTATATAAACCTAACCCTCT |
| NfusAvr32b | 318 | AGAGGGTTAGGTTTATATAaccactagcatgaaggtaccttgtcgttgattTATATAAACCTAACCCTCT |
| NfusAvr33b | 319 | AGAGGGTTAGGTTTATATAgaccactagcatgaaggtaccttgtcgttgattTATATAAACCTAACCCTCT |
| NfusAvr34b | 320 | AGAGGGTTAGGTTTATATAgaccactagcatgaaggtaccttgtcgttgattcTATA-TAAACCTAACCCTCT |
| NfusAvr35b | 321 | AGAGGGTTAGGTTTATATAtgaccactagcatgaaggtaccttgtcgttgattcTATA-TAAACCTAACCCTCT |

TABLE 17

List of all targets having a single RAGT2.4 DNA target sequences preceding a single AvrBs3 (on the same DNA strand), with various spacer sizes used in our yeast SSA assay previously described (International PCT Applications WO 2004/067736 and in (Epinat, Arnould et al. 2003; Chames, Epinat et al. 2005; Arnould, Chames et al. 2006; Smith, Grizot et al. 2006)

| Name | SEQ ID | Sequence |
|---|---|---|
| C_N_RAGAvr05 | 323 | TGTTTATGGTTACTTATaggtaTATATAAACCTAACCCTCT |
| C_N_RAGAvr06 | 324 | TGTTTATGGTTACTTATaaggtaTATATAAACCTAACCCTCT |
| C_N_RAGAvr07 | 325 | TGTTTATGGTTACTTATaaggtacTATATAAACCTAACCCTCT |
| C_N_RAGAvr08 | 326 | TGTTTATGGTTACTTATgaaggtacTATATAAACCTAACCCTCT |
| C_N_RAGAvr09 | 327 | TGTTTATGGTTACTTATgaaggtaccTATATAAACCTAACCCTCT |
| C_N_RAGAvr10 | 328 | TGTTTATGGTTACTTATtgaaggtaccTATATAAACCTAACCCTCT |
| C_N_RAGAvr11 | 329 | TGTTTATGGTTACTTATtgaaggtacctTATATAAACCTAACCCTCT |
| C_N_RAGAvr12 | 330 | TETTTATGGTTACTTATatgaaggtacctTATATAAACCTAACCCTCT |
| C_N_RAGAvr13 | 331 | TGTTTATGGITACTTATatgaaggtaccttTATATAAACCTAACCCTCT |
| C_N_RAGAvr14 | 332 | TGTTTATGGTTACTTATcatgaaggtaccttTATATAAACCTAACCCTCT |
| C_N_RAGAvr15 | 333 | TGTTTATGGITACTTATtagcatgaaggtaccTATATAAACCTAACCCTCT |
| C_N_RAGAvr16 | 334 | TGTTTATGGTTACTTATgcatgaaggtaccttgTATATAAACCTAACCCTCT |
| C_N_RAGAvr17 | 335 | TGTTTATGGTTACTTATgcatgaaggtaccttgtTATATAAACCTAACCCTCT |
| C_N_RAGAvr18 | 336 | TGTTTATGGTTACTTATagcatgaaggtaccttgtTATATAAACCTAACCCTCT |
| C_N_RAGAvr19 | 337 | TGTTTATGGTTACTTATagcatgaaggtaccttgtcTATATAAACCTAACCCTCT |
| C_N_RAGAvr20 | 338 | TGTTTATGGTTACTTATtagcatgaaggtaccttgtcTATATAAACCTAACCCTCT |
| C_N_RAGAvr21 | 339 | TGTTTATGGTTACTTATtagcatgaaggtaccttgtcgTATATAAACCTAACCCTCT |
| C_N_RAGAvr22 | 340 | TGTTTATGGTTACTTATtagcatgaaggtaccttgtcgtTATATAAACCTAACCCTCT |
| C_N_RAGAvr23 | 341 | TGTTTATGGTTACTIATctagcatgaaggtaccttgtcgtTATATAAACCTAACCCTCT |
| C_N_RAGAvr24 | 342 | TGTTTATGGTTACTTATctagcatgaaggtaccttgtcgttTATATAAACCTAACCCTCT |
| C_N_RAGAvr25 | 343 | TGTTTATGGTTACTTATactagcatgaaggtaccttgtcgttTATATAAACCTAACCCTCT |
| C_N_RAGAvr26 | 344 | TGTTTATGGTTACTTATactagcatgaaggtaccttgtcgttgTATATAAACCTAACCCTCT |
| C_N_RAGAvr27 | 345 | TGTTTATGGTTACTTATcactagcatgaaggtaccttgtcgttgTATATAAACCTAACCCTCT |
| C_N_RAGAvr28 | 346 | TGTTTATGGTTACTTATcactagcatgaaggtaccttgtcgttgaTATATAAACCTAACCCTCT |
| C_N_RAGAvr29 | 347 | TGTTTATGGTTACTTATccactagcatgaaggtaccttgtcgttgaTATATAAACCTAACCCTCT |
| C_N_RAGAvr30 | 348 | TGTTTATGGTTACTTATccactagcatgaaggtaccttgtcgttgatTATATAAACCTAACCCTCT |
| C_N_RAGAvr31 | 349 | TGTTTATGGTTACTTATaccactagcatgaaggtaccttgtcgttgatTATATAAACCTAACCCTCT |
| C_N_RAGAvr32 | 350 | TGTTTATGGTTACTTATaccactagcatgaaggtaccttgtcgttgattTATATAAACCTAACCCTCT |
| C_N_RAGAvr33 | 351 | TGTTTATGGTTACTTATgaccactagcatgaaggtaccttgtcgttgattTATATAAACCTAACCCTCT |
| C_N_RAGAvr34 | 352 | TGTTTATGGTTACTTATgaccactagcatgaaggtaccttgtcgttgattcTATATAAACCTAACCCTCT |
| C_N_RAGAvr35 | 353 | TGTTTATGGITACTTATtgaccactagcatgaaggtaccttgtcgttgattcTATATAAACCTAACCCTCT |

TABLE 17-continued

List of all targets having a single RAGT2.4 DNA target sequences preceding a single AvrBs3 (on the same DNA strand), with various spacer sizes used in our yeast SSA assay previously described (International PCT Applications WO 2004/067736 and in (Epinat, Arnould et al. 2003; Chames, Epinat et al. 2005; Arnould, Chames et al. 2006; Smith, Grizot et al. 2006)

| Name | SEQ ID | Sequence |
| --- | --- | --- |
| C_N_RAGAvr36 | 354 | TGTTTATGGITACTTATtgaccactagcatgaaggtaccttgtcgttgattcaTATA-TAAACCTAACCCTCT |
| C_N_RAGAvr37 | 355 | TGTTTATGGTTACTTATctgaccactagcatgaaggtaccttgtcgttgattcaTATA-TAAACCTAACCCTCT |
| C_N_RAGAvr38 | 356 | TGTTTATGGTTACTTATctgaccactagcatgaaggtaccttgtcgttgattcagTATA-TAAACCTAACCCTCT |
| C_N_RAGAvr39 | 357 | TGTTTATGGTTACTTATtctgaccactagcatgaaggtaccttgtcgttgattcagTATA-TAAACCTAACCCTCT |
| C_N_RAGAvr40 | 358 | TGTTTATGGTTACTTATtctgaccactagcatgaaggtaccttgtcgttgattcagtTATA-TAAACCTAACCCTCT |

BurrH_36 based nucleases cleavage activity levels on the collection of targets in yeast are shown in Table 18.

TABLE 18

Activity of BurrH_36 derived nuclease on one of the pseudo-palindromic sequences targets listed in Table 9 and 17 in yeast SSA assay at 37° C. − indicates no detectable activity, + indicates a low activity, ++ a medium activity and +++ a high activity

| DNA target | pCLS23060/pCLS21226 cleavage activity | DNA target | pCLS23060/pCLS21226 cleavage activity |
| --- | --- | --- | --- |
| C_N_RAGAvr05 | − | NfusAvr05b | − |
| C_N_RAGAvr06 | − | NfusAvr06b | − |
| C_N_RAGAvr07 | − | NfusAvr07b | − |
| C_N_RAGAvr08 | − | NfusAvr08b | − |
| C_N_RAGAvr09 | ++ | NfusAvr09b | − |
| C_N_RAGAvr10 | − | NfusAvr10b | ++ |
| C_N_RAGAvr11 | ++ | NfusAvr11b | ++ |
| C_N_RAGAvr12 | ++ | NfusAvr12b | +++ |
| C_N_RAGAvr13 | − | NfusAvr13b | +++ |
| C_N_RAGAvr14 | − | NfusAvr14b | +++ |
| C_N_RAGAvr15 | ++ | NfusAvr15b | + |
| C_N_RAGAvr16 | ++ | NfusAvr16b | +++ |
| C_N_RAGAvr17 | ++ | NfusAvr17b | + |
| C_N_RAGAvr18 | +++ | NfusAvr18b | ++ |
| C_N_RAGAvr19 | ++ | NfusAvr19b | +++ |
| C_N_RAGAvr20 | ++ | NfusAvr20b | +++ |
| C_N_RAGAvr21 | ++ | NfusAvr21b | +++ |
| C_N_RAGAvr22 | + | NfusAvr22b | +++ |
| C_N_RAGAvr23 | − | NfusAvr23b | +++ |
| C_N_RAGAvr24 | ++ | NfusAvr24b | ++ |
| C_N_RAGAvr25 | ++ | NfusAvr25b | − |
| C_N_RAGAvr26 | ++ | NfusAvr26b | − |
| C_N_RAGAvr27 | ++ | NfusAvr27b | − |
| C_N_RAGAvr28 | ++ | NfusAvr28b | − |
| C_N_RAGAvr29 | ++ | NfusAvr29b | ++ |
| C_N_RAGAvr30 | ++ | NfusAvr30b | +++ |
| C_N_RAGAvr31 | ++ | NfusAvr31b | +++ |
| C_N_RAGAvr32 | ++ | NfusAvr32b | +++ |
| C_N_RAGAvr33 | − | NfusAvr33b | +++ |
| C_N_RAGAvr34 | − | NfusAvr34b | +++ |
| C_N_RAGAvr35 | ++ | NfusAvr35b | ++ |
| C_N_RAGAvr36 | ++ | | |
| C_N_RAGAvr37 | ++ | | |
| C_N_RAGAvr38 | ++ | | |
| C_N_RAGAvr39 | ++ | | |
| C_N_RAGAvr40 | − | | |

Example 11

DNA Targeting Using Polymorphism in Position 13 while Preceding Position is Constantly Occupied by Asparagines I to Target A, N to Target G, G to Target T and D to Target C The DNA coding for the DNA binding domain was synthesized according to the human genetic code and cloned in the pUC57 plasmid (SEQ ID NO. 359). DNA binding domain was engineered to target the RAGT2.3 sequence (SEQ ID NO. 360) using in position 13 the following code: I to target A, N to target G, G to target T and D to target C. Insert was obtained by standard molecular biology techniques (BsmBI restriction) and further subcloned in pCLS17419 (SEQ ID NO.124), leading to pCLS21549 (SEQ ID NO. 361). The BurrH_36 based nucleases was tested on the RAGT2.3 and RAGT2.4 targets (SEQ ID NO.222 and SEQ ID NO 223) at 37° C. in the yeast SSA assay as previously described. Targets are designed as pseudo-palindromic sequences (two identical recognition sequences are placed facing each other on both DNA strands). BurrH_36 based nucleases cleavage activity levels on the targets in yeast are shown in Table 19.

S to Target A, N to Target G, G to Target T and D to Target C

The DNA coding for the DNA binding domain was synthesized according to the human genetic code and cloned in the pUC57 plasmid (SEQ ID NO. 359). DNA binding domain was engineered to target the RAGT2.4 sequence (SEQ ID NO. 322) using the following code in position 13: S to target A, N to target G, G to target T and D to target C. Insert was obtained by standard molecular biology techniques (BsmBI restriction) and further subcloned in pCLS20474 (SEQ ID NO. 288), leading to pCLS21558 (SEQ ID NO. 363). The BurrH_36 based nucleases was tested on the RAGT2.3 and RAGT2.4 targets (SEQ ID NO.222 and SEQ ID NO.223) at 37° C. in the yeast SSA assay as previously described. Targets are designed as pseudo-palindromic sequences (two identical recognition sequences are placed facing each other on both DNA strands). BurrH_36 based nucleases cleavage activity levels on the targets in yeast are shown in Table 19.
I to Target A, R to Target G, G to Target T and D to Target C The DNA coding for the DNA binding domain was synthesized according to the human genetic code and cloned in the pUC57 plasmid (SEQ ID NO. 364). DNA binding domain was engineered to target the RAGT2.4 sequence (SEQ ID NO. 322) using the following code in position 13: I to target A, R to target G, G to target T and D to target C. Insert was obtained by standard molecular biology techniques (BsmBI restriction) and further subcloned in pCLS20474 (SEQ ID NO. 288), leading to pCLS21559 (SEQ ID NO. 365). The BurrH_36 based nucleases was tested on the RAGT2.3 and RAGT2.4 targets (SEQ ID NO.223 and SEQ ID NO.222) at 37° C. in the yeast SSA assay as previously described. Targets are designed as pseudo-palindromic sequences (two identical recognition sequences are placed facing each other on both DNA strands). BurrH_36 based nucleases cleavage activity levels on the targets in yeast are shown in Table 19.

TABLE 19

Activity of BurrH_36 derived nuclease on RAGT2.3 and RAGT2.4 sequences targets in yeast SSA assay at 37° C.
− indicates no detectable activity, + indicates a low activity, and +++ a high activity.

| DNA Target | pCLS21549 cleavage activity | pCLS21558 cleavage activity | pCLS21559 cleavage activity |
|---|---|---|---|
| RAGT2.3 | +++ | + | − |
| RAGT2.4 | − | +++ | +++ |

Example 12

Activity of Hybrid Nuclease (TALE-BurrH) Created by Replacing the N-terminal Domain of BurrH by the N-Terminal Domain of AvrBs3

BurrH_36 (SEQ ID NO.2) was chosen as a starting polypeptide to create new specific nuclease. Based on 3D model of burrH_36 and PthXo1-derived TALE structure, point of mutations have been designed in order to minimize the possible steric hindrance between N-terminal domain of AvrBs3 and the first module of BurrH_36. The point mutations have been applied separately on the first module of BurrH36 (Architecture 1) or on the AvrBs3 N-terminal domain (Architecture 2).
Architecture 1
Hybrid TALE-BurrH nuclease was constructed by the fusion of the truncated Δ152 N-terminal domain of AvrBs3 (SEQ ID NO. 366) to the BurrH DNA targeting core. Four amino acid residues of the first DNA binding module of BurrH were mutated (Q3P, V7A, A10T and A16T). The constructs containing an NLS, either a HA or S tag, truncated Δ152 N-terminal domain of AvrBS3 (SEQ ID NO. 366), the BurrH DNA targeting core (targeting either RAGT2.3 (SEQ ID NO. 223) or RAGT2.4 (SEQ ID NO. 222)) containing four point mutations and the BurrH C-terminal domain were synthesized according to the human genetic code and cloned in the pUC57 plasmid leading to respectively pCLS20720 (SEQ ID NO. 367) and pCLS20721 (SEQ ID NO. 368). Inserts were obtained by standard molecular biology techniques (NcoI and BamHI restriction) and further subcloned in pCLS17419 (SEQ ID NO.124), leading to respectively pCLS22251 (SEQ ID NO. 369 encoding for SEQ ID NO. 370) and pCLS22247 (SEQ ID NO. 371 encoding SEQ ID NO. 372).
Architecture 2
In a second TALE-BurrH nuclease architecture, mutations were incorporated in the Δ152 N-terminal domain of avrBs3 (L255A, Q259N, I263M, R266K, A271G, and V275A, (numbering based on the AvrBs3 N-ter (SEQ ID NO.6). The constructs containing an NLS, either a HA or S tag, the Δ152 N-terminal domain of AvrBS3 (SEQ ID NO. 366) containing the six point mutations were synthesized according to the human genetic code and cloned in the pUC57 plasmid leading to respectively pCLS20716 (SEQ ID NO.373) and pCLS20717 (SEQ ID NO. 374). Inserts were obtained by standard molecular biology techniques (NcoI and XmaI restriction) and further subcloned in pCLS17419 (SEQ ID NO.124), leading to respectively pCLS22244 SEQ ID NO. 375) and pCLS22245 (SEQ ID NO. 376). The DNA binding array inserts were then subcloned, from pCLS18127 and pCLS18123 (SEQ ID NO. 219 and SEQ ID NO. 218) into pCLS22244 and pCLS22245 using the two BsmBI sites, leading to respectively pCLS23592 (SEQ ID NO. 377) and pCLS23591 (SEQ ID NO. 378). All molecular biology steps were done according to standard procedures.
All BurrH_36 chimera based nuclease activity were tested as described in example 4, Activity levels on their respective targets in yeast are shown in Table 20.

TABLE 20

Activity of BurrH_36 derived hybrid nuclease on RAGT2.3 and RAGT2.4 sequences targets in yeast SSA assay at 37° C. − indicates no detectable activity, and +++ a high activity.

| DNA Target | pCLS22247 cleavage activity | pCLS22251 cleavage activity | pCLS23591 cleavage activity | pCLS23592 cleavage activity |
|---|---|---|---|---|
| RAGT2.3 | − | +++ | − | ++ |
| RAGT2.4 | +++ | − | +++ | − |

Example 13

Activity of BurrH-Based Nuclease Containing Mutations in the N-Terminal Domain

N-terminal domain of BurrH_36 (SEQ ID NO.2) was chosen as a starting polypeptide to create new N-terminal domains. Amino acid residues were mutated and/or inserted in the N-terminal domain of BurrH_36 to enhance the activity of the BurrH nuclease (see FIG. 16). The constructs containing an NLS a HA tag and various BurrH N-terminal domains containing mutations and or insertion were synthesized according to the human genetic code and cloned in the pUC57 plasmid leading to respectively pCLS20653 to pCLS20662 (SEQ ID NO. 379 to 388). Inserts were obtained by standard molecular biology techniques (NcoI and XmaI restriction) and further subcloned in pCLS17419 (SEQ ID NO.124), leading to respectively pCLS21492 to pCLS21501 (SEQ ID NO. 389 to 398). The DNA binding array inserts were then subcloned, pCLS18120 (SEQ ID NO. 160) into pCLS21492 to pCLS21501 using the two BsmBI sites (as described in Example 3), leading to respectively pCLS21512 to pCLS21521 (SEQ ID NO. 399 to 408). All molecular biology steps were done according to standard procedures.

The BurrH_36 based nucleases were tested, as described in example 3, on the Avr15 target (SEQ ID NO. 192 shown in Table 6) at 37° C. in yeast SSA assay as previously described (WO 2004/067736 and (Epinat, Arnould et al. 2003; Chames, Epinat et al. 2005; Arnould, Chames et al. 2006; Smith, Grizot et al. 2006). BurrH_36 based nucleases cleavage activity levels in yeast are shown on Table 21.

TABLE 21

Activity of BurrH_36 derived nuclease containing mutations in the N-terminal domain on Avr15 sequence target in yeast SSA assay at 37° C. − indicates no detectable activity, and +++ a high activity.

| BurrH nuclease constructs | Cleavage activity on Avr15 target sequence |
|---|---|
| pCLS21512 | +++ |
| pCLS21513 | +++ |
| pCLS21514 | +++ |
| pCLS21515 | +++ |
| pCLS21516 | +++ |
| pCLS21517 | +++ |
| pCLS21518 | +++ |
| pCLS21519 | +++ |
| pCLS21520 | +++ |
| pCLS21521 | +++ |

Example 14

BurrH-based Sequence-specific Nucleases Create Mutations at an Endogenous Locus in Plants A BurrH-based nuclease (SEQ ID NO: 409 and SEQ ID NO: 410) was engineered to recognize a site within the first 90 bp of the coding sequence of the β1,2-xylosyltransferase (XylT1) gene of Nicotiana benthamiana. N. benthamiana seeds were surface sterilized and plated on agarose medium containing Murashige and Skoog salts with an iron supplement. Protoplasts were isolated from young expanded leaves using the protocol described by Wright et al, 2005. Plasmids were introduced separately into aliquots of protoplasts through PEG-mediated transformation (Yoo et al 2007). One plasmid YFP (SEQ ID NO: 411), another encodes the BurrH-based nuclease (SEQ ID NO: 409 and SEQ ID NO: 410). Protoplasts were transformed with 12 μg of each plasmid. Twenty-four hours after transformation, the protoplasts that had been transformed with the YFP-encoding plasmid were subjected to fluorescence microscopy to assess transformation efficiency. More than 90% of the protoplasts expressed YFP. Genomic DNA was then prepared from each of the three aliquots of transformed protoplasts.

Figure 17:
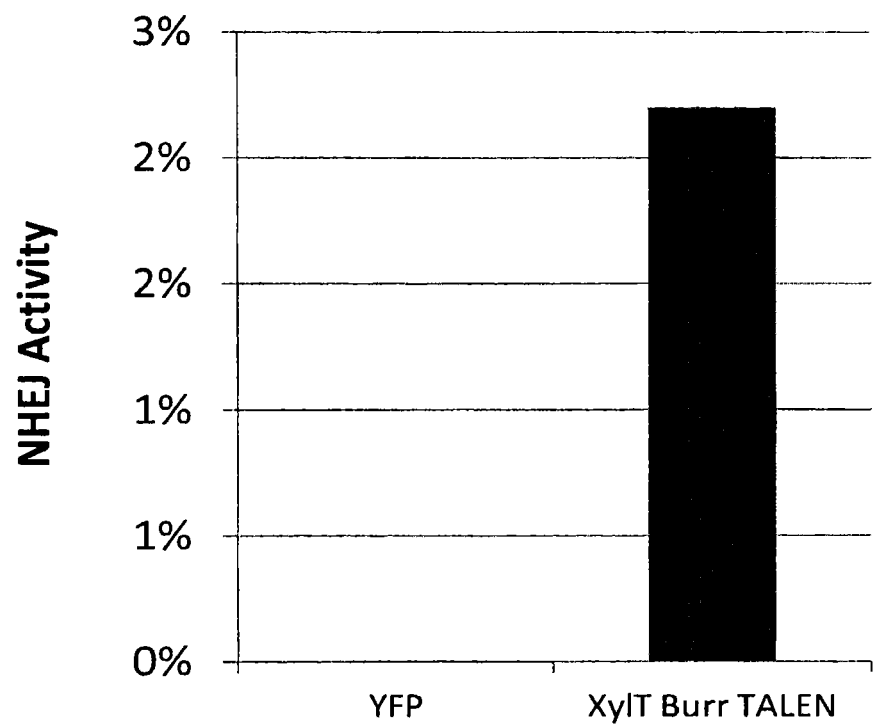
FIG. 17: NHEJ mutagenesis frequency on the xylosyltransferase gene in *Nicotiana benthamiana* by Bur-based TALEN. The transformation with YFP alone serves as the negative control for 454 deep sequencing.

Using genomic DNA as a template, an approximately 300-bp fragment was amplified by PCR that encompasses the recognition site of both the BurrH-based nuclease. The PCR product was then subjected to 454 pyro-sequencing. Sequencing reads with insertion/deletion (indel) mutations in the spacer region between the two DNA binding domains were considered as having been derived from imprecise repair of a cleaved recognition site by non-homologous end-joining (NHEJ). Mutagenesis frequency was estimated as the percentage of sequencing reads with NHEJ mutations out of the total number of sequencing reads. The average mutagenesis frequencies determined for three different transformations are shown in FIG. 17. Of the sequencing reads obtained using the BurrH-based nuclease, 2.2% had indel mutations. No mutagenesis was observed for the negative control (protoplasts transformed with YFP). The 454 pyro-sequencing data demonstrate that BurrH-based nucleases can induce double-strand breaks at an endogenous locus in plant cells.

Example 15

Monomeric MBBBD Nuclease

The catalytic domain of I-TevI (SEQ ID NO. 413), a member of the GIY-YIG endonuclease family was fused to BurrH-36 backbone derived from E5AV36 BURRH protein. I-TevI is a tripartite protein composed of a C-terminal domain responsible for binding specificity, linked to N-terminal catalytic domain by a long flexible linker. The N-terminal catalytic domain contributes to specificity via DNA cleavage selectivity, characterized biochemically and defined by the degenerate CNNNG motif (with CAACGC as the natural cleavage sequence).

The BurrH_36 core scaffold (SEQ ID NO. 414) derived from E5AV36 BURRH protein was composed of a N-terminal domain and a C-terminal domain separated by a small DNA sequence containing two BsmBI sites allowing further cloning of the nucleic acid sequence coding for the DNA binding array. Short sequences were added between the different pieces for cloning purpose or to create linkers at the protein level. The BurrH_36 scaffold was then cloned into vector pCLS7865 (SEQ ID NO. 415) to generate pCLS7865-BurrH_36.

Variants of the I-TevI catalytic domain named TevD02 (SEQ ID NO. 416) and TevM01 (SEQ ID NO. 417) consisting of the N-terminal 183 and 137 residues respectively of the wild-type catalytic domain of I-TevI (SEQ ID NO. 413) was amplified by PCR on template TevCreD02 (SEQ ID NO. 418) protein in plasmid pCLS6615 (SEQ ID NO.419).

TevD02 and TevM01 were fused to the N-terminal part of the BurrH_36 scaffold into the pCLS7865-BurrH_36 by restriction and ligation using standard biological tools, yielding pCLS7865-TevD02::b36 and pCLS7865-TevM01::b36. The TevD02::b36 fusion contains the sequence -QGPSG- linking the BurrH_36-derived DNA binding domain and TevD02 catalytic domain and the TevM01::b36 fusion contains the dipeptide -IA- linking the BurrH_36-derived DNA binding domain and TevM01 catalytic domain.

The nucleic acid sequence coding for the DNA binding array to target the AvrBs3 site (SEQ ID NO.420) was subcloned into the plasmid pCLS7865-TevD02::b36 and pCLS7865-TevM01::b36 by restriction and ligation using standard biological tools to create the subsequent TevD02::b36-AvrBs3 and TevM01::b36-AvrBs3 constructs respectively.

The final TevD02::b36-AvrBs3 and TevM01::b36-AvrBs3 yeast expression plasmids encoding TevD02-burrH and TevM01-burrH chimeric endonucleases (SEQ ID NO.421 and SEQ ID NO. 422) were prepared by yeast in vivo cloning using TevD02::b36-AvrBs3 and TevM01::b36-AvrBs3 constructs. To generate an intact coding sequence by in vivo homologous recombination, approximately 40 ng of TevD02::b36-AvrBs3 or TevM01::b36-AvrBs3 plasmid linearized and 1 ng of the pCLS0542 (SEQ ID NO.423) plasmid linearized were used to transform the yeast S. cerevisiae strain FYC2-6A (MATα, trp1Δ63, leu2Δ1, his3Δ200) using a high efficiency LiAc transformation protocol (Arnould, 2007).

All the yeast target reporter plasmids containing the MBBBD DNA target sequence were constructed as previously described (WO 2004/067736; Epinat, Arnould et al.

2003; Chames, Epinat et al. 2005; Arnould, Chames et al. 2006; Smith, Grizot et al. 2006).

The TevD02::b36-AvrBs3 and TevM01::b36-AvrBs3 constructs were tested in a yeast SSA Assay as previously described on the DNA target containing the terminal G base of I-TevI cleavage sequence CAACGC (SEQ ID NO.424) spaced away of 10 bp from the residue preceded the AvrBs3 recognition site (SEQ ID NO. 425) (CAACGC-10N-AvrBs3 recognition site). TevD02::b36-AvrBs3 and TevM01::b36-AvrBs3 activity levels on the DNA target sequence in yeast cell are shown in Table 22.

TABLE 22

Activity of monomeric MBBBD nuclease in yeast (37° C.). Activity of TevD02::b36-AvrBs3 and TevM01::b36-AvrBs3 on DNA target containing natural I-TevI cleavage site (CAAGC) wherein the terminal G base of the I-TevI cleavage site is spaced away of 10 bp from the residue preceded the single AvrBs3 recognition site (SEQ ID NO. 425). The negative control consists in a TALE scaffold without any DNA binding domain. n.d. indicates no detectable activity, +++ indicates an activity over 0.7 in yeast SSA assay.

| Target sequence | Neg. Control | TevD02::b36-AvrBs3 | TevM01::b36-AvrBs3 |
|---|---|---|---|
| CAAAGCNNNNNNNNNNNATAAACCTAACCCTCT | n.d. | +++ | +++ |

Example 16

Activity of TevI::b36 and TevI::cT11 in Mammalian Cells (CHO-K1) on a Chromosomal Target Construction of TevI::b36EGfpT3q6 construct The ability of TevI::b36 based nucleases to induce targeted mutagenesis on a chromosomal target was monitored using an engineered cell line (CHOpi-10, ref: patent US20120272348 A1) having a single integrated copy of a GFP-encoding sequence under the control of a CMV promoter. A DNA binding array was synthesized (RVD_bhEGFP_T03g06; SEQ ID NO. 426) to target a unique sequence within the encoded GFP gene (SEQ ID NO. 427), thus allowing for measuring in vivo mutagenic activity using two complimentary methods: (i) via a reduction in GFP-positive cells as determined by flow cytometry, and; (ii) via direct amplicon sequencing of the targeted region.

To prepare a suitable vector for expression in mammalian cells, the core TevM01::b36 scaffold insert was first transferred from pCLS7865-TevM01::b36 to pCLS1853 (SEQ ID NO. 428) to create plasmid pCLS21536. The DNA binding array insert from RVD_bhEGFP_T03g06 was subcloned into pCLS21536, yielding plasmid pCLS20293. The final pCLS20293 vector contains the coding sequence for the TevI::b36EGfpT3g6 construct (SEQ ID NO. 429) which targets GFP and whose expression is controlled by a CMV promoter.

Construction of TevI::cT11EGfpT3q12 construct

The sT2 (SEQ ID NO: 433) core TALE scaffold was selected to generate pCLS7865-cTAL11_NFS1 (pCLS9008, SEQ ID NO: 434), where NFS1 designates the amino acid sequence -GSSG- (with underlying restriction sites BamHI and Kpn2I in the coding DNA to facilitate cloning). TevM01 was subcloned into the pCLS9008 backbone, yielding pCLS7865-TevM01::cT11. The fusion contains the sequence -SG- linking the TALE-derived DNA binding domain and I-TevI-derived catalytic domain.

The ability of TevI::cT11 based nucleases to induce targeted mutagenesis on a chromosomal target was monitored using an engineered cell line (CHOpi-10, ref: patent US20120272348 A1) having a single integrated copy of a GFP-encoding sequence under the control of a CMV promoter. A DNA binding array was synthesized (RVD_ctEGFP_T03g12-L1; SEQ ID NO. 435) to target a unique sequence within the encoded GFP gene (SEQ ID NO.436), thus allowing for measuring in vivo mutagenic activity using two complementary methods: (i) via a reduction in GFP-positive cells as determined by flow cytometry, and; (ii) via direct amplicon sequencing of the targeted region.

To prepare a suitable vector for expression in mammalian cells, the core TevM01::cT11 scaffold insert was first transferred from pCLS7865-TevM01::cT11 to pCLS1853 (SEQ ID NO. 428) to create plasmid pCLS20650 (SEQ ID NO. 437). The DNA binding array insert from RVD_ctEGFP_T03g12-L1 was subcloned into pCLS20650, yielding plasmid pCLS20790. The final pCLS20790 vector contains the coding sequence for the Te-vI::cT11EGfpT3g12 construct (SEQ ID NO. 438), which targets GFP and whose expression is controlled by a CMV promoter.

Figure 18:
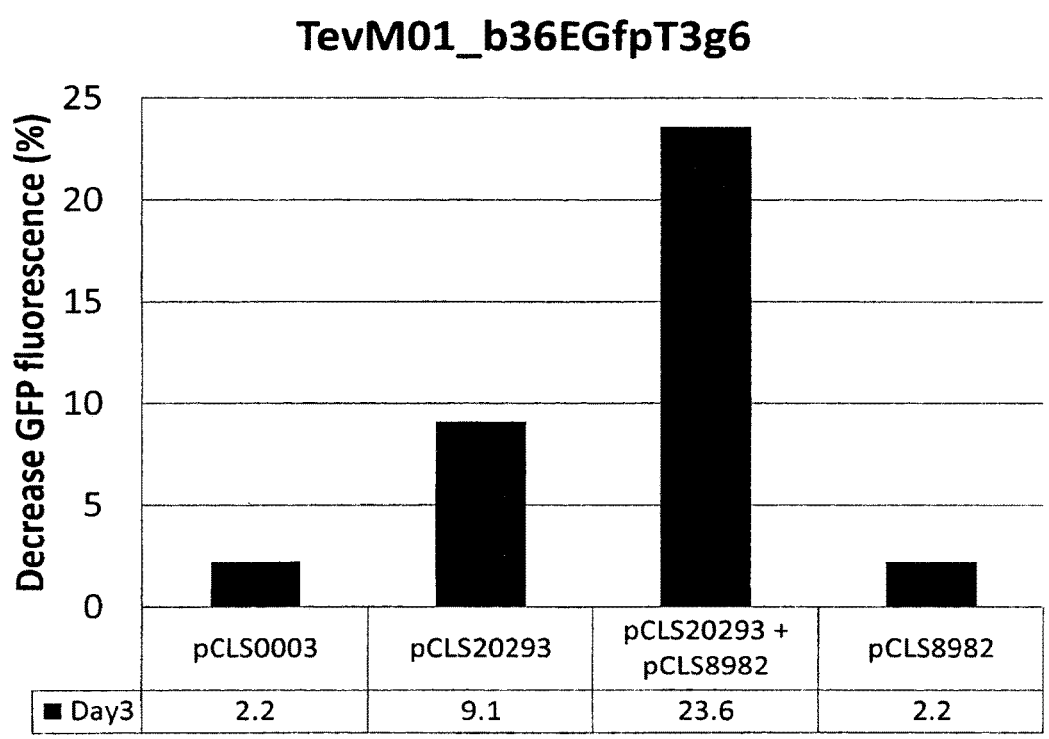
FIG. 18: Activity of the TevM01::b36 construct in mammalian cells (CHO-K1) on a chromosomal target measured as a reduction in GFP fluorescence.
Figure 19:
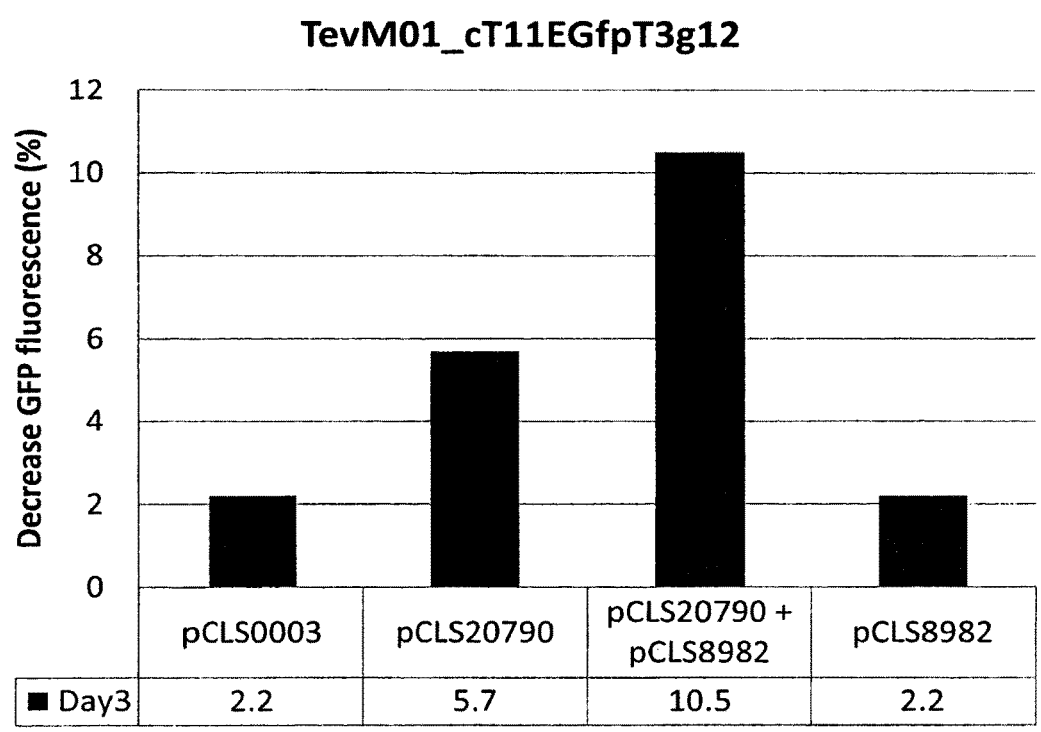
FIG. 19: Activity of the TevM01::cT11 construct in mammalian cells (CHO-K1) on a chromosomal target measured as a reduction in GFP fluorescence.

Activity of TevI::b36 and TevI::cT11 in mammalian cells (CHO-K1) on a chromosomal target Transfection into the CHOpi-10 cell line was carried out using the Amaxa Nucleofector Kit T (Lonza) with a slightly modified protocol: 1 µg of sample plasmid was used in $1 \times 10^6$ cells, in total of 7.25 µg DNA, complemented with pCLS0003 (SEQ ID NO. 430). Samples were additionally assayed with 2 µg of the enhancer reagent scTrex2 (pCLS8982; SEQ ID NO. 431). For baseline controls, plasmids pCLS0003 and pCLS8982 were individually tested in the absence of pCLS20293. Plasmid pCLS2198 containing blue fluorescent protein (BFP) (pCLS2198, SEQ ID NO. 432) was added (250 ng) to all samples to monitor uniformity of transfection. Upon transfection, cells were grown for three days ("Day3" samples) at 37° C. (5% $CO_2$) before being harvested in a volume of 5 ml each. A sample volume (150 µl) was transferred to a 96-well assay block and measured via flow cytometry using a MACSQuant Analyzer (Miltenyi Biotec). FIGS. 18 and 19 illustrate the activity of the TevM01::b36 construct and TevM01::cT11 construct respectively. The activity was measured as a reduction in GFP fluorescence.

Example 17

Transcription Activation Activity of Engineered dBurrH_36 Effector in Mammalian Cells (293H)

To evaluate the ability of BurrH_36 scaffold to specifically activate the transcription of a given gene, a Burrh_36 Effector scaffold was engineered. This scaffold consisted in a regular Burrh_36 scaffold (pCLS23330, SEQ ID NO. 439) fused via its C terminal end, to the VP64 transcription activator domain. To allow quantitative assessment of transfection efficiency of Burrh_36 Effector plasmid, a self cleaving Green Fluorescent Protein (GFP) was fused to the C terminal domain of the VP64 via a 2A self-cleavage peptide. This construction, named pCLS23453 (SEQ ID NO. 440), was used as recipient backbone for the subcloning of two different Burrh_36 DNA binding arrays. The BurrH_36 WT and BurrH_36 HBB DNA binding arrays, containing respectively 20 and 16 DNA binding modules and targeting respectively the DNA binding sites SEQ ID NO. 443 and SEQ ID NO. 444, were subcloned in pCLS23453 using BsmBI insertion sites. The activities of the resulting Burrh_36 effectors (pCLS23638 and pCLS23636; respectively SEQ ID NO. 441 and SEQ ID NO. 442) were then assayed using a transcription activation reporter plasmid. This ectopic reporter plasmid contained one of the DNA binding sites mentioned above (SEQ ID NO. 443 and SEQ ID NO. 444) located upstream from a minimal cytomegalovirus (CMV) promoter driving the Blue Fluorescent Protein (BFP, SEQ ID NO. 449) reporter gene. For quantitative assessment and normalisation of BFP signal induction from one experiment to another, the reporter plasmid also contained a Red Fluorescent Protein (DsRed, SEQ ID NO. 450) constitutively driven by a chimeric promoter encompassing a SV40 early promoter fused to an EM7 promoter. According to this architecture, two ectopic reporter plasmid were generated and named pCLS23601 and pCLS23598, (SEQ ID NO 446 and SEQ ID NO. 448). To assess the specificity of transcription activation by both Effectors, two reporter plasmids (pCLS23598, SEQ ID NO. 448 and pCLS20585, SEQ ID NO. 447) containing non-specific DNA binding site with respect to BurrH_36 WT and HBB Effector respectively were used as a negative controls.

Figure 20A:
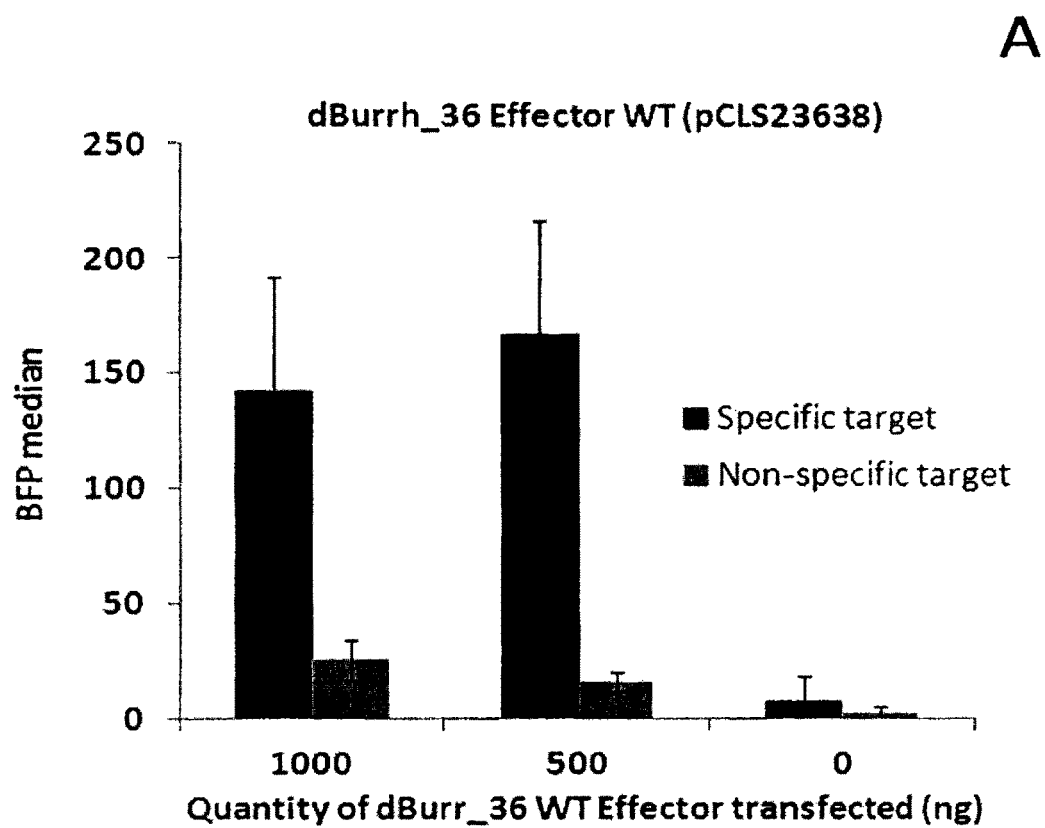
FIGS. 20A and 20B: Activation of BFP transcription by engineered dBurrh_36 WT and dBurrh_36 HBB in 293H cells. 293H cells were transfected in 10 cm plate format (1.2 106 cells/well) with 3 µg of reporter plasmid, 0, 500 or 1000 ng of dBurrh_36 WT (A) or dBurrh_36 HBB (B) plasmids, using Lipofectamine as a transfection agent. 2 days post transfection, living 293H cells displaying red fluorescence signal were first selected by an appropriated gating analysis and GFP/BFP median signals emitted by these cells were then determined using a MACS Quant flow cytometer. The BFP signals, obtained when 3 µg of target was transfected in the absence or in the presence of increasing amounts of its specific Effector, are displayed (black bars). A non-specific target was transfected in the absence or in the presence of increasing amounts of each Effector and the results are displayed as negative controls (grey bars). Experimental data regarding dBurrh_36 Effector and dBurrh_36 Effector are a result of 3 and 1 independent experiments respectively.
Figure 20B:
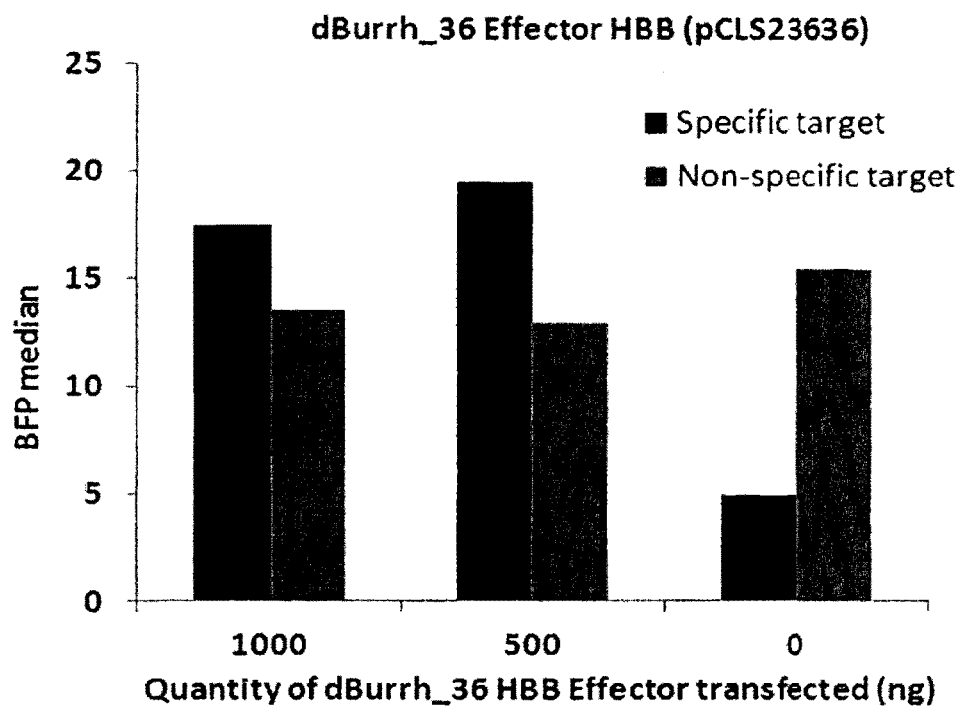

Burrh_36 Effector-dependent induction of BFP signal was determined in 293H cells by flow cytometry, according to the procedure described in the following. Briefly, 293H cells were transfected in 10 cm plate format (1.2 $10^6$ cells/well), using 3000 ng of reporter plasmid and increasing amount of Effector plasmid (0, 500 or 1000 ng), using Lipofectamine as a transfection agent (25 µL/plate). For each experiment, the total DNA content was adjusted 4000 ng/plate with an empty vector (pCLS0003, SEQ ID NO 430). 2 days post transfection, living 293H cells displaying red fluorescence signal were first selected by an appropriated gating analysis and GFP/BFP median signals emitted by these cells were then determined using a MACS Quant flow cytometer. The BFP signals, obtained when a given target was transfected in the absence or in the presence of increasing amounts of Effector, are shown in FIG. 20.

Our results showed that co-transfection of Burrh_36 WT and HBB Effector plasmids along with their respective specific reporter plasmids in 293H cells, led to a significant induction of BFP signal. We obtained 19 and 4 times more BFP signal than for the experiments performed in the absence of Burrh_36 WT and HBB Effectors respectively. Interestingly, a significantly lower increase of BFP signal was observed when a non-specific target was co-transfected with Burrh_36 WT or HBB Effectors (fold enhancement ~10 and 1 respectively). Together, our data show that the Burrh_36 WT and HBB Effectors reported here, enables proficient and specific activation of gene transcription in mammalian cells.

TABLE 23

Alignment of the N-terminal sequences of E5AV36, E5AW45 and E5AW46 BURRH proteins with N-terminal sequence of AvrBs3 (DIALIGN format). Only upper-case letters are considered to be aligned.

```
AvrBs3          1 dpirsrtpsp arellpgpqp dgvqptadrg vsppaggpld gLPArrtmsr

E5AV36_BURRH    1 ms-------- ---------- ---------- ---------- ----------

E5AW45_BURRH    1 ---------- ---------- ---------- ---------- -MPA------

E5AW43_BURRH    1 ---------- ---------- ---------- ---------- -MPV------

AvrBs3         51 trlpsppaps pafsagsfsd llrqfdpslf nTSLFDSLPP FGAHhteaat

E5AV36_BURRH    3 ---------- ---------- ---------- -TAFVDQDKQ MANRLNLSPL

E5AW45_BURRH    4 ---------- ---------- ---------- -TSMHQEDKQ SANGLNLSPL

E5AW43_BURRH    4 ---------- ---------- ---------- -TSVYQKDKP FGARLNLSPF

AvrBs3        101 gewdevqsgl raadappptm rvavtaarpp rakpaprrra aqpsdaspaa

E5AV36_BURRH   22 ER-------- ---------- ---------- ---------- ----------

E5AW45_BURRH   23 ER-------- ---------- ---------- ---------- ----------

E5AW43_BURRH   23 EC-------- ---------- ---------- ---------- ----------

AvrBs3        151 qvdirtigys qqqqekikpk vrstvaqhhe alvghgftha hivalsqhpa

E5AV36_BURRH   24 ---------- ---------- ---------- ---------- ----------

E5AW45_BURRH   25 ---------- ---------- ---------- ---------- ----------
```

TABLE 23-continued

Alignment of the N-terminal sequences of E5AV36, E5AW45 and E5AW46 BURRH proteins with N-terminal sequence of AvrBs3 (DIALIGN format). Only upper-case letters are considered to be aligned.

```
E5AW43_BURRH    25---------- ---------- ---------- ---------- ----------

AvrBs3         201algtvavkyq dmiaalpeat heaiVGVGKQ WSGARALEAL LTVAGELrgp

E5AV36_BURRH    24---------- ---------- ----SKIEKQ YGGATTLAFI SNKQNELAQI

E5AW45_BURRH    25---------- ---------- ----IKIEKH YGGGATLAFI SNQHDELAQV

E5AW43_BURRH    25---------- ---------- ----LKIEKH SGGADALEFI SNKYDALTQV

AvrBs3         251plqLDTGQLL KIAKrggvta veAVHAWRNA LTGAPLn--- -

E5AV36_BURRH    50---LSRADIL KIASYDC--- --AAHALQAV LDCGPMLGKR G

E5AW45_BURRH    51---LSRADIL KIASYDC--- --AAQALQAV LDCGPMLGKR G

E5AW43-BURRH    51---LSRADIL KIACHDC--- --AAHALQAV LDyeqvfrqr g
```

TABLE 24

Alignment of the C-terminal sequences of E5AV36, E5AW45 and E5AW46 BURRH proteins with C-terminal sequence of AvrBs3 (DIALIGN format). Only upper-case letters are considered to be aligned.

```
E5AW43_BURRH     1R--------- ------SNED IVNMAARTGA ---------- ----------

E5AW45_BURRH     1R--------- ------SNEE IVHVAARRGG ---------- ----------

E5AV36_BURRH     1R--------- ------SNEE IVHVAARRGG ---------- ----------

AvRBS3           1sivaqlsrpd palaalTNDH LVALACLGGr paldavkkgl phapalikrt

E5AW43_BURRH    16---------- ---------- ---------- ---------- ----------

E5AW45_BURRH    16---------- ---------- ---------- ---------- ----------

E5AV36_BURRH    16---------- ---------- ---------- ---------- ----------

AvRBS3          51nrripertsh rvadhaqvvr vlgffqchsh paqafddamt qfgmsrhgll

E5AW43_BURRH    16---------- ---------- AGQIRKMAAQ LSGRQ----- ----------

E5AW45_BURRH    16---------- ---------- AGRIRKMVAL LLERQ----- ----------

E5AV36_BURRH    16---------- ---------- AGRIRKMVAP LLERQ----- ----------

AvRBS3         101qlfrrvgvte learsgtlpp ASQRWDRILQ ASGMKrakps ptstqtpdqa

E5AW43_BURRH    31---------- ---------- ---------- ---------- ----------

E5AW45_BURRH    31---------- ---------- ---------- ---------- ----------

E5AV36_BURRH    31---------- ---------- ---------- ---------- ----------

AvRBS3         151slhafadsle rdldapspmh egdqtrassr krsrsdravt gpsaqqsfev

E5AW43_BURRH    31---------- ---------- ---------- -

E5AW45_BURRH    31---------- ---------- ---------- -

E5AV36_BURRH    31---------- ---------- ---------- -

AvRBS3         201rvpeqrdalh lplswrvkrp rtsigggglpd p
```

TABLE 25

Sequence identity matrix showing percentages of identity between the N-terminal amino acids sequences of E5AV36, E5AW45 and E5AW46 and AvrBs3.

| Seq -> N-ter | AvrBs3 | E5AV36 | E5AW45 | E5AW43 |
|---|---|---|---|---|
| AvrBs3 | ID | 0.065 | 0.061 | 0.079 |
| E5AV36_Nter | 0.065 | ID | 0.752 | 0.576 |
| E5AW45_Nter | 0.061 | 0.752 | ID | 0.626 |
| E5AW43_Nter | 0.079 | 0.576 | 0.626 | ID |

TABLE 26

Sequence identity matrix showing percentages of identity between the C-terminal amino acids sequences of E5AV36, E5AW45 and E5AW46 and AvrBs3.

| Seq -> C-ter | E5AW43 | E5AW45 | E5AV36 | AvrBs3 |
|---|---|---|---|---|
| E5AW43_C-ter | ID | 0.666 | 0.666 | 0.038 |
| E5AW45_C-ter | 0.666 | ID | 0.966 | 0.021 |
| E5AV36_C-ter | 0.666 | 0.966 | ID | 0.021 |
| AvRBS3 | 0.038 | 0.021 | 0.021 | ID |

TABLE 27

Amino acid sequences of the modules of E5AV36, E5AW43 and E5AW45

| Module | SEQ ID | Sequence |
|---|---|---|
| E5AV36_1  | (SEQ ID NO. 11) | FSQSD IVKIA GNIGG AQALQ AVLDL ESMLG KRG |
| E5AV36_2  | (SEQ ID NO. 12) | FSRDD IAKMA GNIGG AQTLQ AVLDL ESAFR ERG |
| E5AV36_3  | (SEQ ID NO. 13) | FSQAD IVKIA GNNGG AQALY SVLDV EPTLG KRG |
| E5AV36_4  | (SEQ ID NO. 14) | FSRAD IVKIA GNTGG AQALH TVLDL EPALG KRG |
| E5AV36_5  | (SEQ ID NO. 15) | FSRID IVKIA ANNGG AQALH AVLDL GPTLR ECG |
| E5AV36_6  | (SEQ ID NO. 16) | FSQAT IAKIA GNIGG AQALQ MVLDL GPALG KRG |
| E5AV36_7  | (SEQ ID NO. 17) | FSQAT IAKIA GNIGG AQALQ TVLDL EPALC ERG |
| E5AV36_8  | (SEQ ID NO. 18) | FSQAT IAKMA GNNGG AQALQ TVLDL EPALR KRD |
| E5AV36_9  | (SEQ ID NO. 19) | FRQAD IIKIA GNDGG AQALQ AVIEH GPTLR QHG |
| E5AV36_10 | (SEQ ID NO. 20) | FNLAD IVKMA GNIGG AQALQ AVLDL KPVLD EHG |
| E5AV36_11 | (SEQ ID NO. 21) | FSQPD IVKMA GNIGG AQALQ AVLSL GPALR ERG |
| E5AV36_12 | (SEQ ID NO. 22) | FSQPD IVKIA GNTGG AQALQ AVLDL ELTLV EHG |
| E5AV36_13 | (SEQ ID NO. 23) | FSQPD IVRIT GNRGG AQALQ AVLAL ELTLR ERG |
| E5AV36_14 | (SEQ ID NO. 24) | FSQPD IVKIA GNSGG AQALQ AVLDL ELTFR ERG |
| E5AV36_15 | (SEQ ID NO. 25) | FSQAD IVKIA GNDGG TQALH AVLDL ERMLG ERG |
| E5AV36_16 | (SEQ ID NO. 26) | FSRAD IVNVA GNNGG AQALK AVLEH EATLN ERG |
| E5AV36_17 | (SEQ ID NO. 27) | FSRAD IVKIA GNGGG AQALK AVLEH EATLD ERG |
| E5AV36_18 | (SEQ ID NO. 28) | FSRAD IVRIA GNGGG AQALK AVLEH GPTLN ERG |
| E5AV36_19 | (SEQ ID NO. 29) | FNLTD IVEMA ANSGG AQALK AVLEH GPTLR QRG |
| E5AV36_20 | (SEQ ID NO. 30) | LSLID IVEIA SNGG  AQALK AVLKY GPVLM QAG |
| E5AW43_1  | (SEQ ID NO. 31) | FARAD IIKIT GNGGG AQALK AVVVH GPTLN ECG |
| E5AW43_2  | (SEQ ID NO. 32) | FARAD IIKIT GNGGG AQALK AVVVH GPTLN ECG |
| E5AW43_3  | (SEQ ID NO. 33  | YSGAD IVKIA GNGGG ARALK AVVMH GPTLC ESG |
| E5AW43_4  | (SEQ ID NO. 34) | YSGAD IVKIA SNGGG AQALE AVAMH GSTLC ERG |
| E5AW43_5  | (SEQ ID NO. 35) | YCRTD IAKIA GNGGG AQALK AIVMH GPTLC ERG |
| E5AW43_6  | (SEQ ID NO. 36) | YSRTD IVKIA DNNGG AQALK AVFEH GPALT QAG |
| E5AW45_1  | (SEQ ID NO. 37) | FSRAD IVRIA GNGGG AQALY SVLDV EPTLG KRG |
| E5AW45_2  | (SEQ ID NO. 38) | FSQVD VVKIA GGG   AQALH TVLEI GPTLG ERG |
| E5AW45_3  | (SEQ ID NO. 39) | FSRGD IVTIA GNNGG AQALQ AVLEL EPTLR ERG |
| E5AW45_4  | (SEQ ID NO. 40) | FNQAD IVKIA GNGGG AQALQ AVLDV EPALG KRG |
| E5AW45_5  | (SEQ ID NO. 41) | FSRVD IAKIA GGG   AQALQ AVLGL EPTLR KRG |
| E5AW45_6  | (SEQ ID NO. 42) | FHPTD IIKIA GNNGG AQALQ AVLDL ELMLR ERG |

TABLE 27-continued

Amino acid sequences of the modules of E5AV36, E5AW43 and E5AW45

| | | |
|---|---|---|
| E5AW45_7 | (SEQ ID NO. 43) | FSQAD IVKMA SNIGG AQALQ AVLNL EPALC ERG |
| E5AW45_8 | (SEQ ID NO. 44) | FSQPD IVKMA GNSGG AQALQ AVLDL ELAFR ERG |
| E5AW45_9 | (SEQ ID NO. 45) | FSQAD IVKMA SNIGG AQALQ AVLEL EPALH ERG |
| E5AW45_10 | (SEQ ID NO. 46) | FSQAN IVKMA GNSGG AQALQ AVLDL ELVFR ERG |
| E5AW45_11 | (SEQ ID NO. 47) | FSQPE IVEMA GNIGG AQALH TVLDL ELAFR ERG |
| E5AW45_12 | (SEQ ID NO. 48) | VRQAD IVKIV GNNGG AQALQ AVFEL EPTLR ERG |
| E5AW45_13 | (SEQ ID NO. 49) | FNQAT IVKIA ANGGG AQALY SVLDV EPTLD KRG |
| E5AW45_14 | (SEQ ID NO. 50) | FSRVD IVKIA GGG AQALH TAFEL EPTLR KRG |
| E5AW45_15 | (SEQ ID NO. 51) | FNPTD IVKIA GNKGG AQALQ AVLEL EPALR ERG |
| E5AW45_16 | (SEQ ID NO. 52) | FNQAT IVKMA GNAGG AQALY SVLDV EPALR ERG |
| E5AW45_17 | (SEQ ID NO. 53) | FSQPE IVKIA GNIGG AQALH TVLEL EPTLH KRG |
| E5AW45_18 | (SEQ ID NO. 54) | FNPTD IVKIA GNSGG AQALQ AVLEL EPAFR ERG |
| E5AW45_19 | (SEQ ID NO. 55) | FGQPD IVKMA SNIGG AQALQ AVLEL EPALR ERG |
| E5AW45_20 | (SEQ ID NO. 56) | FSQPD IVEMA GNIGG AQALQ AVLEL EPAFR ERG |
| E5AW45_21 | (SEQ ID NO. 57) | FSQSD IVKIA GNIGG AQALQ AVLEL EPTLR ESD |
| E5AW45_22 | (SEQ ID NO. 58) | FRQAD IVNIA GNDGS TQALK AVIEH GPRLR QRG |
| E5AW45_23 | (SEQ ID NO. 59) | FNRAS IVKIA GNSGG AQALQ AVLKH GPTLD ERG |
| E5AW45_24 | (SEQ ID NO. 60) | FNLTN IVKIA GNGGG AQALK AVIEH GPTLQ QRG |
| E5AW45_25 | (SEQ ID NO. 61) | FNLTD IVEMA GKGGG AQALK AVLEH GPTLR QRG |
| E5AW45_26 | (SEQ ID NO. 62) | FNLID IVEMA SNTGG AQALK TVLEH GPTLR QRD |
| E5AW45_27 | (SEQ ID NO. 63) | LSLID IVEIA SNGG AQALK AVLKY GPVLM QAG |

TABLE 28

Matrix comparing the identity of the amino acid sequences of
the different module from E5AV36, EAW45, E5AW43 and AvrBs3.
The last value in Bold represents the percentage of identity
of each module with one representative repeat of AvrBs3
(SEQ ID NO. 10).

```
Seq->   E5AW45_12 E5AW45_21 E5AW45_31 E5AW45_20 E5AV36_2 E5AW45_28 E5AW45_30
        E5AV36_14 E5AV36_12 E5AV36_13 E5AW45_27 E5AW45_29 E5AW45_19 E5AV36_11
        E5AV36_10 E5AW45_15 E5AW45_18 E5AW45_26 E5AW45_3 E5AW45_25 E5AV36_1
        E5AV36_15 E5AV36_3 E5AW45_1 E5AW45_13 E5AW45_16 E5AW45_4 E5AV36_6
        E5AV36_7 E5AV36_8 E5AV36_4 E5AW45_14 E5AW45_17 E5AW45_2 E5AV36_5
        E5AV36_16 E5AV36_17 E5AW43_1 E5AW43_2 E5AW43_3 E5AW43_4 E5AW43_5
        E5AV36_18 E5AW45_23 E5AV36_9 E5AW45_22 E5AV36_19 E5AW45_25 E5AW45_26
        E5AV36_20 E5AW45_27 E5AW45_24 E5AW43_6 AvrBs3

E5AW45_12 ID 0.757 0.545 0.696 0.575 0.666 0.666 0.727 0.696 0.727
           0.696 0.727 0.727 0.696 0.636 0.757 0.727 0.696 0.787 0.666 0.666
           0.666 0.696 0.606 0.606 0.636 0.696 0.606 0.666 0.636 0.636 0.666
           0.666 0.606 0.666 0.666 0.696 0.606 0.606 0.606 0.606 0.575 0.666
           0.666 0.727 0.636 0.575 0.575 0.515 0.484 0.484 0.606 0.606 0.352

E5AW45_21 0.757 ID 0.636 0.787 0.666 0.727 0.696 0.787 0.787 0.757
           0.757 0.787 0.787 0.787 0.696 0.787 0.757 0.696 0.818 0.727 0.787
           0.696 0.696 0.636 0.606 0.636 0.696 0.666 0.727 0.696 0.666 0.666
           0.757 0.666 0.727 0.666 0.727 0.575 0.575 0.636 0.575 0.545 0.696
           0.666 0.696 0.575 0.606 0.606 0.606 0.545 0.545 0.606 0.575 0.352

E5AW45_31 0.545 0.636 ID 0.848 0.727 0.848 0.787 0.787 0.696 0.696
           0.696 0.696 0.727 0.757 0.606 0.636 0.666 0.636 0.636 0.545 0.666
           0.666 0.606 0.575 0.545 0.696 0.606 0.636 0.727 0.696 0.696 0.575
```

TABLE 28-continued

Matrix comparing the identity of the amino acid sequences of
the different module from E5AV36, EAW45, E5AW43 and AvrBs3.
The last value in Bold represents the percentage of identity
of each module with one representative repeat of AvrBs3
(SEQ ID NO. 10).

```
              0.757 0.575 0.606 0.575 0.575 0.393 0.393 0.424 0.454 0.393 0.545
              0.515 0.454 0.454 0.545 0.545 0.545 0.454 0.454 0.454 0.424 0.323

E5AW45_20     0.696 0.787 0.848 ID    0.787 0.878 0.787 0.818 0.727 0.757
              0.818 0.848 0.878 0.878 0.696 0.787 0.818 0.666 0.787 0.666 0.727
              0.666 0.636 0.606 0.545 0.696 0.696 0.666 0.727 0.696 0.666 0.606
              0.727 0.606 0.636 0.666 0.666 0.484 0.484 0.515 0.515 0.484 0.666
              0.606 0.606 0.575 0.666 0.666 0.606 0.545 0.545 0.545 0.545 0.323

E5AV36_2      0.575 0.666 0.727 0.787 ID    0.818 0.757 0.757 0.666 0.636
              0.727 0.727 0.727 0.757 0.666 0.696 0.727 0.696 0.696 0.696 0.727
              0.636 0.575 0.575 0.484 0.636 0.636 0.666 0.727 0.696 0.666 0.545
              0.575 0.484 0.636 0.606 0.636 0.484 0.484 0.454 0.515 0.515 0.575
              0.575 0.515 0.424 0.515 0.515 0.454 0.424 0.424 0.454 0.484 0.235

E5AW45_28     0.666 0.727 0.848 0.878 0.818 ID    0.909 0.939 0.818 0.787
              0.787 0.787 0.818 0.848 0.696 0.757 0.818 0.757 0.727 0.666 0.757
              0.727 0.666 0.606 0.575 0.727 0.727 0.666 0.727 0.727 0.696 0.575
              0.666 0.575 0.666 0.636 0.666 0.484 0.484 0.515 0.545 0.484 0.606
              0.636 0.575 0.515 0.606 0.575 0.515 0.484 0.484 0.515 0.515 0.294

E5AW45_30     0.666 0.696 0.787 0.787 0.757 0.909 ID    0.878 0.757 0.727
              0.757 0.757 0.727 0.757 0.727 0.696 0.757 0.727 0.696 0.636 0.727
              0.727 0.666 0.606 0.606 0.727 0.696 0.666 0.727 0.727 0.666 0.545
              0.636 0.545 0.636 0.636 0.666 0.484 0.484 0.515 0.545 0.454 0.606
              0.666 0.575 0.515 0.575 0.545 0.484 0.484 0.484 0.545 0.454 0.323

E5AV36_14     0.727 0.787 0.787 0.818 0.757 0.939 0.878 ID    0.878 0.848
              0.727 0.727 0.757 0.787 0.666 0.757 0.818 0.787 0.787 0.727 0.787
              0.757 0.727 0.666 0.636 0.666 0.727 0.666 0.727 0.666 0.696 0.636
              0.727 0.636 0.727 0.666 0.727 0.545 0.545 0.575 0.606 0.545 0.666
              0.696 0.636 0.545 0.606 0.575 0.515 0.515 0.515 0.575 0.515 0.323

E5AV36_12     0.696 0.787 0.696 0.727 0.666 0.818 0.757 0.878 ID    0.818
              0.727 0.727 0.727 0.757 0.727 0.727 0.696 0.757 0.757 0.696 0.787
              0.757 0.727 0.666 0.636 0.636 0.727 0.666 0.727 0.636 0.727 0.606
              0.727 0.636 0.727 0.666 0.727 0.575 0.575 0.606 0.606 0.545 0.666
              0.666 0.666 0.515 0.545 0.545 0.515 0.545 0.545 0.575 0.545 0.382

E5AV36_13     0.727 0.757 0.696 0.757 0.636 0.787 0.727 0.848 0.818 ID
              0.696 0.696 0.727 0.757 0.606 0.727 0.696 0.727 0.787 0.696 0.727
              0.696 0.666 0.666 0.575 0.606 0.666 0.606 0.666 0.606 0.636 0.606
              0.696 0.606 0.666 0.666 0.696 0.575 0.575 0.545 0.575 0.515 0.696
              0.636 0.606 0.545 0.575 0.575 0.515 0.515 0.515 0.545 0.484 0.323

E5AW45_27     0.696 0.757 0.696 0.818 0.727 0.787 0.757 0.727 0.727 0.696
              ID    0.939 0.878 0.848 0.757 0.757 0.727 0.666 0.727 0.666 0.757
              0.727 0.696 0.636 0.636 0.727 0.757 0.727 0.818 0.727 0.727 0.575
              0.696 0.606 0.666 0.666 0.696 0.545 0.545 0.606 0.666 0.545 0.666
              0.666 0.606 0.545 0.606 0.575 0.575 0.575 0.575 0.545 0.575 0.411

E5AW45_29     0.727 0.787 0.696 0.848 0.727 0.787 0.757 0.727 0.727 0.696
              0.939 ID    0.909 0.848 0.757 0.787 0.757 0.666 0.757 0.666 0.757
              0.727 0.696 0.636 0.636 0.727 0.757 0.727 0.787 0.727 0.727 0.606
              0.757 0.636 0.666 0.696 0.727 0.545 0.545 0.575 0.636 0.515 0.696
              0.666 0.636 0.575 0.636 0.606 0.606 0.575 0.575 0.575 0.606 0.382

E5AW45_19     0.727 0.787 0.727 0.878 0.727 0.818 0.727 0.757 0.727 0.727
              0.878 0.909 ID    0.878 0.727 0.818 0.787 0.696 0.757 0.666 0.727
              0.666 0.636 0.575 0.606 0.727 0.727 0.666 0.727 0.696 0.666 0.606
              0.727 0.606 0.666 0.636 0.666 0.515 0.515 0.515 0.575 0.515 0.636
              0.636 0.636 0.575 0.666 0.636 0.636 0.545 0.545 0.575 0.575 0.382

E5AV36_11     0.696 0.787 0.757 0.878 0.757 0.848 0.757 0.787 0.757 0.757
              0.848 0.848 0.878 ID    0.757 0.787 0.757 0.696 0.757 0.696 0.757
              0.696 0.666 0.606 0.575 0.727 0.727 0.757 0.757 0.727 0.696 0.606
              0.727 0.666 0.727 0.636 0.666 0.575 0.575 0.606 0.606 0.575 0.696
              0.696 0.666 0.606 0.666 0.666 0.606 0.575 0.575 0.606 0.606 0.352

E5AV36_10     0.636 0.696 0.606 0.696 0.666 0.696 0.727 0.666 0.727 0.606
              0.757 0.757 0.727 0.757 ID    0.727 0.696 0.666 0.666 0.606 0.696
              0.666 0.636 0.606 0.636 0.696 0.727 0.666 0.696 0.636 0.666 0.515
              0.606 0.545 0.666 0.606 0.666 0.575 0.575 0.575 0.545 0.515 0.636
              0.727 0.636 0.515 0.636 0.636 0.575 0.575 0.575 0.606 0.515 0.411
```

TABLE 28-continued

Matrix comparing the identity of the amino acid sequences of
the different module from E5AV36, EAW45, E5AW43 and AvrBs3.
The last value in Bold represents the percentage of identity
of each module with one representative repeat of AvrBs3
(SEQ ID NO. 10).

```
E5AW45_15  0.757 0.787 0.636 0.787 0.696 0.757 0.696 0.757 0.727 0.727
           0.757 0.787 0.818 0.787 0.727 ID 0.939 0.818 0.818 0.727 0.727
           0.696 0.666 0.636 0.636 0.727 0.787 0.666 0.727 0.666 0.727 0.666
           0.696 0.636 0.696 0.666 0.727 0.575 0.575 0.575 0.575 0.606 0.696
           0.727 0.666 0.606 0.696 0.696 0.606 0.545 0.545 0.696 0.636 0.411

E5AW45_18  0.727 0.757 0.666 0.818 0.727 0.818 0.757 0.818 0.696 0.696
           0.727 0.757 0.787 0.757 0.696 0.939 ID 0.787 0.787 0.696 0.696
           0.666 0.636 0.606 0.606 0.696 0.757 0.636 0.696 0.636 0.696 0.636
           0.666 0.606 0.666 0.636 0.696 0.545 0.545 0.545 0.545 0.575 0.666
           0.727 0.636 0.575 0.696 0.666 0.575 0.515 0.515 0.666 0.606 0.382

E5AW45_26  0.696 0.696 0.636 0.666 0.696 0.757 0.727 0.787 0.757 0.727
           0.666 0.666 0.696 0.696 0.666 0.818 0.787 ID 0.757 0.696 0.757
           0.727 0.666 0.606 0.575 0.636 0.696 0.636 0.696 0.666 0.666 0.575
           0.606 0.545 0.696 0.636 0.666 0.575 0.575 0.515 0.545 0.575 0.606
           0.636 0.636 0.515 0.575 0.575 0.484 0.484 0.484 0.575 0.545 0.352

E5AW45_3   0.787 0.818 0.636 0.787 0.696 0.727 0.696 0.787 0.757 0.787
           0.727 0.757 0.757 0.757 0.666 0.818 0.787 0.757 ID 0.787 0.727
           0.696 0.727 0.727 0.606 0.636 0.696 0.636 0.696 0.666 0.727 0.727
           0.727 0.666 0.787 0.787 0.787 0.606 0.606 0.606 0.606 0.606 0.787
           0.727 0.666 0.606 0.666 0.666 0.606 0.575 0.575 0.636 0.636 0.382

E5AW45_25  0.666 0.727 0.545 0.666 0.696 0.666 0.636 0.727 0.696 0.696
           0.666 0.666 0.666 0.696 0.606 0.727 0.696 0.696 0.787 ID 0.727
           0.636 0.696 0.696 0.606 0.575 0.696 0.696 0.696 0.696 0.727 0.806
           0.696 0.677 0.696 0.636 0.696 0.575 0.575 0.545 0.545 0.606 0.666
           0.666 0.636 0.515 0.575 0.606 0.515 0.531 0.531 0.575 0.545 0.352

E5AV36_1   0.666 0.787 0.666 0.727 0.727 0.757 0.727 0.787 0.787 0.727
           0.757 0.757 0.727 0.757 0.696 0.727 0.696 0.757 0.727 0.727 ID
           0.818 0.787 0.727 0.666 0.636 0.818 0.787 0.757 0.696 0.787 0.636
           0.757 0.636 0.666 0.636 0.696 0.515 0.515 0.545 0.606 0.515 0.636
           0.636 0.606 0.545 0.545 0.545 0.484 0.545 0.545 0.575 0.545 0.352

E5AV36_15  0.666 0.696 0.666 0.666 0.636 0.727 0.727 0.757 0.757 0.696
           0.727 0.727 0.666 0.696 0.666 0.696 0.666 0.727 0.696 0.636 0.818
           ID 0.757 0.696 0.636 0.666 0.757 0.696 0.727 0.636 0.787 0.606
           0.696 0.666 0.696 0.666 0.727 0.545 0.545 0.575 0.606 0.515 0.666
           0.636 0.606 0.636 0.515 0.515 0.454 0.515 0.515 0.545 0.515 0.352

E5AV36_3   0.696 0.696 0.606 0.636 0.575 0.666 0.666 0.727 0.727 0.666
           0.696 0.696 0.636 0.666 0.636 0.666 0.636 0.666 0.727 0.696 0.787
           0.757 ID 0.909 0.848 0.787 0.848 0.757 0.727 0.727 0.818 0.666
           0.757 0.696 0.696 0.696 0.727 0.575 0.575 0.606 0.606 0.545 0.696
           0.666 0.636 0.575 0.575 0.575 0.545 0.545 0.545 0.606 0.575 0.352

E5AW45_1   0.606 0.636 0.575 0.606 0.575 0.606 0.606 0.666 0.666 0.666
           0.636 0.636 0.575 0.606 0.606 0.636 0.606 0.606 0.727 0.696 0.727
           0.696 0.909 ID 0.818 0.727 0.818 0.696 0.666 0.636 0.818 0. 666
           0.696 0.636 0.666 0.696 0.757 0.606 0.606 0.606 0.606 0.575 0.787
           0.666 0.575 0.545 0.575 0.606 0.545 0.545 0.545 0.606 0.545 0.382

E5AW45_13  0.606 0.606 0.545 0.545 0.484 0.575 0.606 0.636 0.636 0.575
           0.636 0.636 0.606 0.606 0.575 0.636 0.636 0.575 0.606 0.606 0.666
           0.636 0.848 0.818 ID 0.818 0.818 0.696 0.696 0.666 0.696 0.575
           0.696 0.575 0.636 0.575 0.696 0.545 0.545 0.545 0.575 0.515 0.636
           0.696 0.575 0.515 0.606 0.575 0.545 0.484 0.484 0.636 0.484 0.382

E5AW45_16  0.636 0.636 0.696 0.696 0.636 0.727 0.727 0.666 0.636 0.606
           0.727 0.727 0.727 0.727 0.696 0.727 0.696 0.636 0.636 0.575 0.636
           0.666 0.787 0.727 0.818 ID 0.787 0.696 0.757 0.757 0.696 0.545
           0.636 0.575 0.606 0.606 0.636 0.515 0.515 0.515 0.515 0.484 0.606
           0.666 0.575 0.545 0.606 0.606 0.575 0.454 0.454 0.575 0.484 0.323

E5AW45_4   0.696 0.696 0.606 0.696 0.636 0.727 0.696 0.727 0.727 0.666
           0.757 0.757 0.727 0.727 0.727 0.787 0.757 0.696 0.696 0.696 0.818
           0.757 0.848 0.818 0.818 0.787 ID 0.787 0.757 0.727 0.818 0.606
           0.696 0.636 0.636 0.636 0.727 0.606 0.606 0.606 0.606 0.575 0.696
           0.727 0.666 0.606 0.606 0.636 0.545 0.545 0.545 0.666 0.575 0.382
```

TABLE 28-continued

Matrix comparing the identity of the amino acid sequences of the different module from E5AV36, EAW45, E5AW43 and AvrBs3. The last value in Bold represents the percentage of identity of each module with one representative repeat of AvrBs3 (SEQ ID NO. 10).

```
E5AV36_6    0.606 0.666 0.636 0.666 0.666 0.666 0.666 0.666 0.666 0.606
            0.727 0.727 0.666 0.757 0.666 0.666 0.636 0.636 0.636 0.696 0.787
            0.696 0.757 0.696 0.696 0.696 0.787 ID 0.878 0.818 0.787 0.575
            0.727 0.636 0.636 0.545 0.606 0.545 0.545 0.545 0.545 0.545 0.636
            0.666 0.636 0.545 0.515 0.515 0.484 0.515 0.515 0.575 0.545 0.352

E5AV36_7    0.666 0.727 0.727 0.727 0.727 0.727 0.727 0.727 0.727 0.666
            0.818 0.787 0.727 0.757 0.696 0.727 0.696 0.696 0.696 0.696 0.757
            0.727 0.727 0.666 0.696 0.757 0.757 0.878 ID 0.848 0.787 0.606
            0.757 0.636 0.636 0.606 0.666 0.545 0.545 0.575 0.575 0.575 0.636
            0.666 0.606 0.515 0.484 0.484 0.484 0.484 0.484 0.545 0.515 0.411

E5AV36_8    0.636 0.696 0.696 0.696 0.696 0.727 0.727 0.666 0.636 0.606
            0.727 0.727 0.696 0.727 0.636 0.666 0.636 0.666 0.666 0.696 0.696
            0.636 0.727 0.636 0.666 0.757 0.727 0.818 0.848 ID 0.757 0.606
            0.696 0.545 0.606 0.575 0.575 0.454 0.454 0.454 0.454 0.454 0.545
            0.575 0.575 0.484 0.515 0.515 0.575 0.424 0.424 0.484 0.484 0.323

E5AV36_4    0.636 0.666 0.696 0.666 0.666 0.696 0.666 0.696 0.727 0.636
            0.727 0.727 0.666 0.696 0.666 0.727 0.696 0.666 0.727 0.727 0.787
            0.787 0.818 0.818 0.696 0.696 0.818 0.787 0.787 0.757 ID 0.757
            0.787 0.696 0.727 0.666 0.727 0.575 0.575 0.575 0.575 0.545 0.696
            0.666 0.575 0.545 0.545 0.545 0.575 0.545 0.545 0.575 0.606 0.411

E5AW45_14   0.666 0.666 0.575 0.606 0.545 0.575 0.545 0.636 0.606 0.606
            0.575 0.606 0.606 0.606 0.515 0.666 0.636 0.575 0.727 0.806 0.636
            0.606 0.666 0.666 0.575 0.545 0.606 0.575 0.606 0.606 0.757 ID
            0.757 0.741 0.666 0.606 0.666 0.515 0.515 0.515 0.515 0.545 0.636
            0.575 0.575 0.515 0.545 0.575 0.545 0.468 0.468 0.575 0.575 0.382

E5AW45_17   0.666 0.757 0.757 0.727 0.575 0.666 0.636 0.727 0.727 0.696
            0.696 0.757 0.727 0.727 0.606 0.696 0.666 0.606 0.727 0.696 0.757
            0.696 0.757 0.696 0.696 0.636 0.696 0.727 0.757 0.696 0.787 0.757
            ID 0.727 0.666 0.636 0.696 0.515 0.515 0.545 0.545 0.515 0.666
            0.636 0.606 0.545 0.575 0.575 0.575 0.515 0.515 0.636 0.545 0.411

E5AW45_2    0.606 0.666 0.575 0.606 0.484 0.575 0.545 0.636 0.636 0.606
            0.606 0.636 0.606 0.666 0.545 0.636 0.606 0.545 0.666 0.677 0.636
            0.666 0.696 0.636 0.575 0.575 0.636 0.636 0.636 0.545 0.696 0.741
            0.727 ID 0.666 0.606 0.666 0.545 0.545 0.575 0.575 0.545 0.696
            0.636 0.606 0.545 0.575 0.606 0.575 0.531 0.531 0.606 0.545 0.411

E5AV36_5    0.666 0.727 0.606 0.636 0.636 0.666 0.636 0.727 0.727 0.666
            0.666 0.666 0.666 0.727 0.666 0.696 0.666 0.696 0.787 0.696 0.666
            0.696 0.696 0.666 0.636 0.606 0.636 0.636 0.636 0.606 0.727 0.666
            0.666 0.666 ID 0.666 0.696 0.666 0.666 0.636 0.636 0.606 0.727
            0.696 0.636 0.545 0.666 0.606 0.606 0.636 0.636 0.606 0.666 0.382

E5AV36_16   0.666 0.666 0.575 0.666 0.606 0.636 0.636 0.666 0.666 0.666
            0.666 0.696 0.636 0.636 0.606 0.666 0.636 0.636 0.787 0.636 0.636
            0.666 0.696 0.696 0.575 0.606 0.636 0.545 0.606 0.575 0.666 0.606
            0.636 0.606 0.666 ID 0.878 0.666 0.666 0.636 0.636 0.606 0.848
            0.696 0.606 0.636 0.666 0.666 0.606 0.545 0.545 0.636 0.636 0.294

E5AV36_17   0.696 0.727 0.575 0.666 0.636 0.666 0.666 0.727 0.727 0.696
            0.696 0.727 0.666 0.666 0.666 0.727 0.696 0.666 0.787 0.696 0.696
            0.727 0.727 0.757 0.696 0.636 0.727 0.606 0.666 0.575 0.727 0.666
            0.696 0.666 0.696 0.878 ID 0.727 0.727 0.727 0.727 0.696 0.878
            0.787 0.666 0.636 0.666 0.696 0.606 0.575 0.575 0.727 0.666 0.352

E5AW43_1    0. 606 0.575 0.393 0.484 0.484 0.484 0.484 0.545 0.575 0.575
            0.545 0.545 0.515 0.575 0.575 0.575 0.545 0.575 0.606 0.575 0.515
            0.545 0.575 0.606 0.545 0.515 0.606 0.545 0.545 0.454 0.575 0.515
            0.515 0.545 0.666 0.666 0.727 ID 1.000 0.727 0.636 0.727 0.787
            0.696 0.696 0.575 0.575 0.606 0.515 0.515 0.515 0.666 0.606 0.323

E5AW43_2    0.606 0.575 0.393 0.484 0.484 0.484 0.484 0.545 0.575 0.575
            0.545 0.545 0.515 0.575 0.575 0.575 0.545 0.575 0.606 0.575 0.515
            0.545 0.575 0.606 0.545 0.515 0.606 0.545 0.545 0.454 0.575 0.515
            0.515 0.545 0.666 0.666 0.727 1.000 ID 0.727 0.636 0.727 0.787
            0.696 0.696 0.575 0.575 0.606 0.515 0.515 0.515 0.666 0.606 0.323

E5AW43_3    0.606 0.636 0.424 0.515 0.454 0.515 0.515 0.575 0.606 0.545
            0.606 0.575 0.515 0.606 0.575 0.575 0.545 0.515 0.606 0.545 0.545
```

TABLE 28-continued

Matrix comparing the identity of the amino acid sequences of
the different module from E5AV36, EAW45, E5AW43 and AvrBs3.
The last value in Bold represents the percentage of identity
of each module with one representative repeat of AvrBs3
(SEQ ID NO. 10).

```
          0.575 0.606 0.606 0.545 0.515 0.606 0.545 0.575 0.454 0.575 0.515
          0.545 0.575 0.636 0.636 0.727 0.727 0.727 ID    0.818 0.787 0.757
          0.666 0.636 0.575 0.575 0.606 0.515 0.575 0.575 0.666 0.666 0.382

E5AW43_4  0.606 0.575 0.454 0.515 0.515 0.545 0.545 0.606 0.606 0.575
          6.666 0.636 0.575 0.606 0.545 0.575 0.545 0.545 0.606 0.545 0.606
          0.606 0.606 0.606 0.575 0.515 0.606 0.545 0.545 0.454 0.575 0.515
          0.545 0.575 0.636 0.636 0.727 0.636 0.636 0.818 ID    0.727 0.727
          0.666 0.606 0.545 0.575 0.575 0.545 0.575 0.575 0.636 0.636 0.441

E5AW43_5  0.575 0.545 0.393 0.484 0.515 0.484 0.454 0.545 0.545 0.515
          0.545 0.515 0.515 0.575 0.515 0.606 0.575 0.575 0.606 0.606 0.515
          0.515 0.545 0.575 0.515 0.484 0.575 0.545 0.575 0.454 0.545 0.545
          0.515 0.545 0.606 0.606 0.696 0.727 0.727 0.787 0.727 ID    0.727
          0.666 0.606 0.545 0.606 0.636 0.515 0.515 0.515 0.696 0.666 0.352

E5AV36_18 0.666 0.696 0.545 0.666 0.575 0.606 0.606 0.666 0.666 0.696
          0.666 0.696 0.636 0.696 0.636 0.696 0.606 0.606 0.787 0.666 0.636
          0.666 0.696 0.787 0.636 0.606 0.696 0.636 0.636 0.545 0.696 0.636
          0.666 0.696 0.727 0.848 0.878 0.787 0.787 0.757 0.727 0.727 ID
          0.787 0.696 0.696 0.727 0.757 0.666 0.636 0.636 0.757 0.696 0.382

E5AW45_23 0.666 0.666 0.515 0.606 0.575 0.636 0.666 0.696 0.666 0.636
          0.666 0.666 0.636 0.696 0.727 0.727 0.727 0.636 0.727 0.666 0.636
          0.636 0.666 0.666 0.696 0.666 0.727 0.666 0.666 0.575 0.666 0.575
          0.636 0.636 0.696 0.696 0.787 0.696 0.696 0.666 0.666 0.666 0.787
          ID    0.696 0.606 0.696 0.666 0.606 0.575 0.575 0.727 0.606 0.352

E5AV36_9  0.727 0.696 0.454 0.606 0.515 0.575 0.575 0.636 0.666 0.606
          0.606 0.636 0.636 0.666 0.636 0.666 0.636 0.636 0.666 0.636 0.606
          0.606 0.636 0.575 0.575 0.575 0.666 0.636 0.606 0.575 0.575 0.575
          0.606 0.606 0.636 0.606 0.666 0.696 0.696 0.636 0.606 0.606 0.696
          0.696 ID    0.787 0.666 0.666 0.606 0.545 0.545 0.727 0.636 0.382

E5AW45_22 0.636 0.575 0.454 0.575 0.424 0.515 0.515 0.545 0.515 0.545
          0.545 0.575 0.575 0.606 0.515 0.606 0.575 0.515 0.606 0.515 0.545
          0.636 0.575 0.545 0.515 0.545 0.606 0.545 0.515 0.484 0.545 0.515
          0.545 0.545 0.545 0.636 0.636 0.575 0.575 0.575 0.545 0.545 0.696
          0.606 0.787 ID    0.666 0.666 0.606 0.545 0.545 0.696 0.606 0.352

E5AV36_19 0.575 0.606 0.545 0.666 0.515 0.606 0.575 0.606 0.545 0.575
          0.606 0.636 0.666 0.666 0.636 0.696 0.696 0.575 0.666 0.575 0.545
          0.515 0.575 0.575 0.606 0.606 0.606 0.515 0.484 0.515 0.545 0.545
          0.575 0.575 0.666 0.666 0.666 0.575 0.666 0.575 0.575 0.606 0.727
          0.696 0.666 0.666 ID    0.909 0.848 0.666 0.666 0.787 0.666 0.352

E5AW45_25 0.575 0.606 0.545 0.666 0.515 0.575 0.545 0.575 0.545 0.575
          0.575 0.606 0.636 0.666 0.636 0.696 0.666 0.575 0.666 0.606 0.545
          0.515 0.575 0.606 0.575 0.606 0.636 0.515 0.484 0.515 0.545 0.575
          0.575 0.606 0.606 0.666 0.696 0.606 0.606 0.606 0.575 0.636 0.757
          0.666 0.666 0.666 0.909 ID    0.818 0.636 0.636 0.818 0.636 0.382

E5AW45_26 0.515 0.606 0.545 0.606 0.454 0.515 0.484 0.515 0.515 0.515
          0.575 0.606 0.636 0.606 0.575 0.606 0.575 0.484 0.606 0.515 0.484
          0.454 0.545 0.545 0.545 0.575 0.545 0.484 0.484 0.575 0.575 0.545
          0.575 0.575 0.606 0.606 0.606 0.515 0.515 0.515 0.545 0.515 0.666
          0.606 0.606 0.606 0.848 0.818 ID    0.666 0.666 0.696 0.575 0.382

E5AV36_20 0.484 0.545 0.454 0.545 0.424 0.484 0.484 0.515 0.545 0.515
          0.575 0.575 0.545 0.575 0.575 0.545 0.515 0.484 0.575 0.531 0.545
          0.515 0.545 0.545 0.484 0.454 0.545 0.515 0.484 0.424 0.545 0.468
          0.515 0.531 0.636 0.545 0.575 0.515 0.515 0.575 0.575 0.515 0.636
          0.575 0.545 0.545 0.666 0.636 0.666 ID    1.000 0.606 0.666 0.470

E5AW45_27 0.484 0.545 0.454 0.545 0.424 0.484 0.484 0.515 0.545 0.515
          0.575 0.575 0.545 0.575 0.575 0.545 0.515 0.484 0.575 0.531 0.545
          0.515 0.545 0.545 0.484 0.454 0.545 0.515 0.484 0.424 0.545 0.468
          0.515 0.531 0.636 0.545 0.575 0.515 0.515 0.575 0.575 0.515 0.636
          0.575 0.545 0.545 0.666 0.636 0.666 1.000 ID    0.606 0.666 0.470
```

TABLE 28-continued

Matrix comparing the identity of the amino acid sequences of the different module from E5AV36, EAW45, E5AW43 and AvrBs3. The last value in Bold represents the percentage of identity of each module with one representative repeat of AvrBs3 (SEQ ID NO. 10).

```
E5AW45_24  0.606 0.606 0.454 0.545 0.454 0.515 0.545 0.575 0.575 0.545
           0.545 0.575 0.575 0.606 0.606 0.696 0.666 0.575 0.636 0.575 0.575
           0.545 0.606 0.606 0.636 0.575 0.666 0.575 0.545 0.484 0.575 0.575
           0.636 0.606 0.606 0.636 0.727 0.666 0.666 0.666 0.636 0.696 0.757
           0.727 0.727 0.696 0.787 0.818 0.696 0.606 0.606 ID 0.696 0.411

E5AW43_6   0.606 0.575 0.424 0.545 0.484 0.515 0.454 0.515 0.545 0.484
           0.575 0.606 0.575 0.606 0.515 0.636 0.606 0.545 0.636 0.545 0.545
           0.515 0.575 0.545 0.484 0.484 0.575 0.545 0.515 0.484 0.606 0.575
           0.545 0.545 0.666 0.636 0.666 0.606 0.606 0.666 0.636 0.666 0.696
           0.606 0.636 0.606 0.666 0.636 0.575 0.666 0.666 0.696 ID 0.382 avr        0.352 0.352 0.323 0.323 0.235 0.294 0.323 0.323 0.382 0.323 0.411
           0.382 0.382 0.352 0.411 0.411 0.382 0.352 0.382 0.352 0.352 0.352
           0.352 0.382 0.382 0.323 0.382 0.352 0.411 0.323 0.411 0.382 0.411
           0.411 0.382 0.294 0.352 0.323 0.323 0.382 0.441 0.352 0.382 0.352
           0.382 0.352 0.352 0.382 0.382 0.470 0.470 0.411 0.382 ID
```

TABLE 29

Amino acid sequences of the putative protein JCVI_A (SEQ ID NO.72) resulting from the fusion of ECG96325 (SEQ ID NO.68) and ECG96326 (SEQ ID NO. 69).

N-ter:

MDKNAILKISICNGAHLAITTLLENWDALIDLELEPKDIVSIASHGGATQAITTLLNK-WDDLRDKG (SEQ ID NO.74)

Modules:

| | |
|---|---|
| LEPKD IVSIA SNNGA TQAIA TLLAK WDSLI AKG | (SEQ ID NO. 77) |
| LQPKD IVSIA SHGGA TQAIT TLLNR WGDLR AKE | (SEQ ID NO. 78) |
| LEPKD IVSIA SHDGA TQAIT TLLEK WDELR AKG | (SEQ ID NO. 79) |
| LEPKD IVSIA SHIGA NQTIT TLLNK WGALI DLE | (SEQ ID NO. 80) |
| LEPKD IVSIA SHGGA NKAIT TLLEK WAALR AKE | (SEQ ID NO. 81) |
| LEPKD IVSIA SHNGA TQAIT TLLEK WGDLR AKE | (SEQ ID NO. 82) |
| LEPKD IVSIA SNTGA NKTIT RLLEK WGDLR AKE | (SEQ ID NO. 83) |
| LEPKD IVSIA SHDGS NQTIT KLLEK WDELR AKG | (SEQ ID NO. 84) |
| LEPKD IVSIA SHIGA NQTIT TLLNK WGALI DLE | (SEQ ID NO. 85) |
| LEPKD IVSIA SHIGA TQAIT TLLNK WAALR AKG | (SEQ ID NO. 86) |
| LDPKD IVSIA SHDGS NQTIT KLLEK WDELR AKE | (SEQ ID NO. 87) |
| LESKD IVSIA SNNGA TQTIT RLLEK WDELR AKG | (SEQ ID NO. 88) |
| LDPKD IVSIA SHGGA TQAIT TLLNR WGDLI DLE | (SEQ ID NO. 89) |
| LEPKD IVSIA SHKGA NQVIT TLLEK WDDLI SQG | (SEQ ID NO. 90) |

C-ter:

| | |
|---|---|
| YTKSS IVSIA STQNG VLGLL EALG | (SEQ ID NO. 110) |

TABLE 30

Amino acid sequences of the putative protein JCVI_B (SEQ ID NO. 73), resulting from the fusion of EBN19408 (SEQ ID NO. 70) and EBN19409 (SEQ ID NO. 67)

N-ter:

MINLYFARSFVFMSNQTEQKILKFKLELRYPTESAQLIRAGFNRDQADRIILRGSSQRT-VAKLLEIHKTLLAHPYR (SEQ ID NO. 75)

Modules:

| | |
|---|---|
| ITYDD LTRIA ARNGG SKNLV AVQAN YAALT ELG | (SEQ ID NO. 91) |
| FSAKD IVQMV SHGGG SKNLE VVQAN YAALT GLG | (SEQ ID NO. 92) |
| FRTED IVQMV SHDGG SKNLA AMIDK STALK DLG | (SEQ ID NO. 93) |
| FRTED IVQMV SHDGS SKNLA AMIDK STALK GLG | (SEQ ID NO. 94) |
| FRTEG IVQMV SHGGS SKNLA AMIDK STALK GLG | (SEQ ID NO. 95) |
| FRTEG IVQMV SHGGG SKNLV AVQAN YAALT GLG | (SEQ ID NO. 96) |
| FRTEG IVQMV SHGGG SKNLV AVQAN YAALT GLG | (SEQ ID NO. 97) |
| FRTED IVQMV SHDGG SKNLV AVQAN YAALT GLG | (SEQ ID NO. 98) |
| FRTED IVQMV SHDGG SKNLV AIIDK STALK GLG | (SEQ ID NO. 99) |
| FRTED IVQMV SNNGG SKNLA AIIDK STALK GLG | (SEQ ID NO. 100) |
| FRTED IVQMV SHGGG SKNLE VVQAN YAALT GLG | (SEQ ID NO. 101) |
| FRTEG IVQMV SHGGG SKNLV AVQAN YAALT GLG | (SEQ ID NO. 102) |
| FRTED IVQMV SHDGG SKNLA AMIDK YTALK DLG | (SEQ ID NO. 103) |
| FRTED IVQMV SHDGG SKNLA AIIDK STALK GLG | (SEQ ID NO. 104) |
| FLTED IVQMV SHDGG SKNLE VVQAS YAALT GLG | (SEQ ID NO. 105) |

C-ter

| | |
|---|---|
| YTKSS IVSIA STQNG VLGLL EALG | (SEQ ID NO. 110) |

TABLE 31

Amino acid sequences of the putative protein JCVI_ORF_1096688327480 (ECR81667) (SEQ ID NO. 71).

N-ter

| | |
|---|---|
| WSNKAITTLLENWEKLIKKG | (SEQ ID NO. 76) |

Modules:

| | |
|---|---|
| LKPED IVTIA SHHGG SQAIT TLLEN WDDLL KLE | (SEQ ID NO. 106) |
| LKFED IVSIA SHNGA SQAIT TLLEN WEKLI KKG | (SEQ ID NO. 107) |
| LKPED IVSIA SHSGG SQAIT TLLEN WDDLI DQE | (SEQ ID NO. 108) |

C-ter:

| | |
|---|---|
| YTESE IVNIF SSQDG VLKLL AELD | (SEQ ID NO. 109) |

TABLE 32

Alignment of the N-terminal sequences of JCVIA and JVCIB with those of E5AV36, E5AW45, E5AW43 and AvrBs3 (DIALIGN format). (only upper-case letters are considered to be aligned).

| | | |
|---|---|---|
| JCVI_B | 1 | m--------- ---------- ---------- ---------- ---------- |
| JCVI_A | 1 | m--------- ---------- ---------- ---------- ---------- |
| AvrBs3 | 1 | dpirsrtpsp arellpgpqp dgvqptadrg vsppaggpld gLPArrtmsr |
| E5AV36_BURRH | 1 | ms-------- ---------- ---------- ---------- ---------- |
| E5AW45_BURRH | 1 | ---------- ---------- ---------- ---------- -MPA------ |
| E5AW43_BURRH | 1 | ---------- ---------- ---------- ---------- -MPV------ |
| JCVI_B | 2 | ---------- ---------- ---------- ---------- ----INLyf- |
| JCVI_A | 2 | ---------- ---------- ---------- ---------- -------DKN Ai-------- |
| AvrBs3 | 51 | trlpsppaps pafsagsfsd llrqfdpslf nTSLFDSLPP FGAHhteaat |
| E5AV36_BURRH | 3 | ---------- ---------- ---------- -TAFVDQDKQ MANRLNLSPL |
| E5AW45_BURRH | 4 | ---------- ---------- ---------- -TSMHQEDKQ SANGLNLSPL |
| E5AW43_BURRH | 4 | ---------- ---------- ---------- -TSVYQKDKP FGARLNLSPF |
| JCVI_B | 7 | ---------- ---------- ---------- ---------- ---------- |
| JCVI_A | 7 | ---------- ---------- ---------- ---------- ---------- |
| AvrBs3 | 101 | gewdevqsgl raadappptm rvavtaarpp rakpaprrra aqpsdaspaa |
| E5AV36_BURRH | 22 | ER-------- ---------- ---------- ---------- ---------- |
| E5AW45_BURRH | 23 | ER-------- ---------- ---------- ---------- ---------- |
| E5AW43_BURRH | 23 | EC-------- ---------- ---------- ---------- ---------- |
| JCVI_B | 7 | ---------- ---------- ---------- ---------- ---------- |
| JCVI_A | 7 | ---------- ---------- ---------- ---------- ---------- |
| AvrBs3 | 151 | qvdlrtlgys qqqqekikpk vrstvaqhhe alvghgftha hivalsqhpa |
| E5AV36_BURRH | 24 | ---------- ---------- ---------- ---------- ---------- |
| E5AW45_BURRH | 25 | ---------- ---------- ---------- ---------- ---------- |
| E5AW43_BURRH | 25 | ---------- ---------- ---------- ---------- ---------- |
| JCVI_B | 7 | ---------- ---------- ---------- ---ARSFVFM SNQTEQkilk |
| JCVI_A | 7 | ---------- ---------- ----LKISIC NGAHLAITTL LENWDA---- |
| AvrBs3 | 201 | algtvavkyq dmiaalpeat heaiVGVGKQ WSGARALEAL LTVAGE---- |
| E5AV36_BURRH | 24 | ---------- ---------- ----SKIEKQ YGGATTLAFI SNKQNE---- |
| E5AW45_BURRH | 25 | ---------- ---------- ----IKIEKH YGGGATLAFI SNQHDE---- |
| E5AW43_BURRH | 25 | ---------- ---------- ----LKIEKH SGGADALEFI SNKYDA---- |
| JCVI_B | 24 | fkleLRYPte sAQL-Iragf nrdqadRIIL RGSSQRTVA- ----KLLEih |
| JCVI_A | 29 | ----L----- -IDLELEP-- ------KDIV SIASHGGAT- ----QAIT-- |
| AvrBs3 | 247 | ----LRGPp- ---LQLDT-- ------GQLL KIAKRGGVTa veavHAWR-- |
| E5AV36_BURRH | 46 | ----L----- -AQI-LSR-- ------ADIL KIASYDCAA- ----HALQ-- |
| E5AW45_BURRH | 47 | ----L----- -AQV-LSR-- ------ADIL KIASYDCAA- ----QALQ-- |
| E5AW43_BURRH | 47 | ----L----- -TQV-LSR-- ------ADIL KIACHDCAA- ----HALQ-- |
| JCVI_B | 68 | kTLLahpyr- ---- |
| JCVI_A | 54 | -TLLNKWDDL RDKG |

TABLE 32-continued

Alignment of the N-terminal sequences of JCVIA and JVCIB with those of E5AV36, E5AW45, E5AW43 and AvrBS3 (DIALIGN format). (only upper-case letters are considered to be aligned).

| | | |
|---|---|---|
| AvrBs3 | 279 | -NALTGAPLn ---- |
| E5AV36_BURRH | 70 | -AVLDCGPML GKRG |
| E5AW45_BURRH | 71 | -AVLDCGPML GKRG |
| E5AW43_BURRH | 71 | -AVLDYEQVF RQRG |

TABLE 33

Alignment of the C-terminal sequences of JCVIA and JVCIB with those of E5AV36, E5AW45, E5AW43 and AvrBS3 (DIALIGN format). Only upper-case letters are considered to be aligned).

| | | |
|---|---|---|
| EAW43_BURRH | 1 | R--------- ------SNED IVNMAARTGA ---------- ---------- |
| E5AW45_BURRH | 1 | R--------- ------SNEE IVHVAARRGG ---------- ---------- |
| E5AV36_BURRH | 1 | R--------- ------SNEE IVHVAARRGG ---------- ---------- |
| AvRBS3 | 1 | sivaqlsrpd palaalTNDH LVALACLGGr paldavkkgl phapalikrt |
| JVCI_A | 1 | Y--------- ------TKSS IVSIASTQNG ---------- ---------- |
| ECR81667 | 1 | Y--------- ------TESE IVNIFSSQDG ---------- ---------- |
| EAW43_BURRH | 16 | ---------- ---------- A-GQIRKMA- ---------- ---------- |
| E5AW45_BURRH | 16 | ---------- ---------- A-GRIRKMV- ---------- ---------- |
| E5AV36_BURRH | 16 | ---------- ---------- A-GRIRKMV- ---------- ---------- |
| AvRBS3 | 51 | nrripertsh rvadhaqvvr VLGffqchsh paqafddamt qfgmsrhgll |
| JVCI_A | 16 | ---------- ---------- VLG------- ---------- ---------- |
| ECR81667 | 16 | ---------- ---------- VLK------- ---------- ---------- |
| EAW43_BURRH | 24 | ---------- ---------- ---------- ---------- ---------- |
| E5AW45_BURRH | 24 | ---------- ---------- ---------- ---------- ---------- |
| E5AV36_BURRH | 24 | ---------- ---------- ---------- ---------- ---------- |
| AvRBS3 | 101 | qlfrrvgvte learsgtlpp asqrwdrilq asgmkrakps ptstqtpdqa |
| JVCI_A | 19 | ---------- ---------- ---------- ---------- ---------- |
| ECR81667 | 19 | ---------- ---------- ---------- ---------- ---------- |
| EAW43_BURRH | 24 | -----AQLSG RQ-------- ---------- ---------- ---------- |
| E5AW45_BURRH | 24 | -----ALLLE RQ-------- ---------- ---------- ---------- |
| E5AV36_BURRH | 24 | -----APLLE RQ-------- ---------- ---------- ---------- |
| AvRBS3 | 151 | slhafADSLE RDLDapspmh egdqtrassr krsrsdravt gpsaqqsfev |
| JVCI_A | 19 | -------LLE -ALg------ ---------- ---------- ---------- |
| ECR81667 | 19 | -------LLA -ELD------ ---------- ---------- ---------- |
| EAW43_BURRH | 31 | ---------- ---------- ---------- - |
| E5AW45_BURRH | 31 | ---------- ---------- ---------- - |
| E5AV36_BURRH | 31 | ---------- ---------- ---------- - |

TABLE 33-continued

Alignment of the C-terminal sequences of JCVIA and JVCIB with those of E5AV36, E5AW45, E5AW43 and AvrBS3 (DIALIGN format). Only upper-case letters are considered to be aligned).

| | | |
|---|---|---|
| AvRBS3 | 201 | rvpeqrdalh lplswrvkrp rtsiggglpd p |
| JVCI_A | 25 | ---------- ---------- ---------- - |
| ECR81667 | 25 | ---------- ---------- ---------- - |

TABLE 34

List of peptide linkers that can be used in MBBBD proteins.

| Name (PDB) | Amino Acids | Size | Length | Sequence | SEQ ID NO |
|---|---|---|---|---|---|
| 1a8h_1 | 285-287 | 3 | 6,636 | NVG | 451 |
| 1dnpA_1 | 130-133 | 4 | 7,422 | DSVI | 452 |
| 1d8cA_2 | 260-263 | 4 | 8,782 | IVEA | 453 |
| 1ckqA_3 | 169-172 | 4 | 9,91 | LEGS | 454 |
| 1sbp_1 | 93-96 | 4 | 10,718 | YTST | 455 |
| 1ev7A_1 | 169-173 | 5 | 11,461 | LQENL | 456 |
| 1alo_3 | 360-364 | 5 | 12,051 | VGRQP | 457 |
| 1amf_1 | 81-85 | 5 | 13,501 | LGNSL | 458 |
| 1adjA_3 | 323-328 | 6 | 14,835 | LPEEKG | 459 |
| 1fcdC_1 | 76-81 | 6 | 14,887 | QTYQPA | 460 |
| 1al3_2 | 265-270 | 6 | 15,485 | FSHSTT | 461 |
| 1g3p_1 | 99-105 | 7 | 17,903 | GYTYINP | 462 |
| 1acc_3 | 216-222 | 7 | 19,729 | LTKYKSS | 463 |
| 1ahjB_1 | 106-113 | 8 | 17,435 | SRPSESEG | 464 |
| 1acc_1 | 154-161 | 8 | 18,776 | PELKQKSS | 465 |
| 1af7_1 | 89-96 | 8 | 22,502 | LTTNLTAF | 466 |
| 1heiA_1 | 322-330 | 9 | 13,534 | TATPPGSVT | 467 |
| 1bia_2 | 268-276 | 9 | 16,089 | LDNFINRPV | 468 |
| 1igtB_1 | 111-119 | 9 | 19,737 | VSSAKTTAP | 469 |
| 1nfkA_1 | 239-248 | 10 | 13,228 | DSKAPNASNL | 470 |
| 1au7A_1 | 103-112 | 10 | 20,486 | KRRTTISIAA | 471 |
| 1bpoB_1 | 138-148 | 11 | 21,645 | PVKMFDRHSSL | 472 |
| 1b0pA_2 | 625-635 | 11 | 26,462 | APAETKAEPMT | 473 |
| 1c05A_2 | 135-148 | 14 | 23,819 | YTRLPERSELPAEI | 474 |
| 1gcb_1 | 57-70 | 14 | 27,39 | VSTDSTPVTNQKSS | 475 |
| 1bt3A_1 | 38-51 | 14 | 28,818 | YKLPAVTTMKVRPA | 476 |
| 1b3oB_2 | 222-236 | 15 | 20,054 | IARTDLKKNRDYPLA | 477 |
| 16vpA_6 | 312-332 | 21 | 23,713 | TEEPGAPLTTPPTLHGNQARA | 478 |
| 1dhx_1 | 81-101 | 21 | 42,703 | ARFTLAVGDNRVLDMASTYFD | 479 |
| 1b8aA_1 | 95-120 | 26 | 31,305 | IVVLNRAETPLPLDPTGKVKAELDTR | 480 |

TABLE 34-continued

List of peptide linkers that can be used in MBBBD proteins.

| Name (PDB) | Amino Acids | Size | Length | Sequence | SEQ ID NO |
|---|---|---|---|---|---|
| 1qu6A_1 | 79-106 | 28 | 51,301 | ILNKEKKAVSPLLLTTTNSSEGLSMGNY | 481 |
| NFS1 | — | 20 | — | GSDITKSKISEKMKGGGPSG | 482 |
| NFS2 | — | 23 | — | GSDITKSKISEKMKGLGPDGRKA | 483 |
| CFS1 | — | 10 | — | SITKSKISGS | 484 |
| RM2 | — | 32 | — | AAGGSALTAGALSLTAGALSLTAGALSGGGGS | 485 |
| BQY | — | 25 | — | AAGASSVSASGHIAPLSLPSSPPSVGS | 486 |
| QGPSG | — | 5 | — | QGPSG | 487 |
| LGPDGRKA | — | 8 | — | LGPDGRKA | 488 |
| GRSGSDP | — | 7 | — | GRSGSDP | 489 |
| IA | — | 2 | — | IA | 490 |
| SG | — | 2 | — | SG | 491 |
| TAL1 | — | 15 | — | SGGSGSNVGSGSGSG | 492 |
| TAL2 | — | 20 | — | SGGSGSLTTNLTAFSGSGSG | 493 |
| TAL3 | — | 22 | — | SGGSGSKRRTTISIAASGSGSG | 494 |
| TAL4 | — | 17 | — | SGGSGSVGRQPSGSGSG | 495 |
| TAL5 | — | 26 | — | SGGSGSYTRLPERSELPAEISGSGSG | 496 |
| TAL6 | — | 38 | — | SGGSGSIVVLNRAETPLPLDPTGKVKAELDTRSGSGSG | 497 |
| TAL7 | — | 21 | — | SGGSGSTATPPGSVTSGSGSG | 498 |
| TAL8 | — | 21 | — | SGGSGSLDNFINRPVSGSGSG | 499 |
| TAL9 | — | 21 | — | SGGSGSVSSAKTTAPSGSGSG | 500 |
| TAL10 | — | 22 | — | SGGSGSDSKAPNASNLSGSGSG | 501 |
| TAL11 | — | 23 | — | SGGSGSPVKMFDRHSSLSGSGSG | 502 |
| TAL12 | — | 23 | — | SGGSGSAPAETKAEPMTSGSGSG | 503 |
| TAL13 | — | 26 | — | SGGSGSVSTDSTPVTNQKSSSGSGSG | 504 |
| TAL14 | — | 16 | — | SGGSGSDSVISGSGSG | 505 |
| TAL15 | — | 33 | — | SGGSGSARFTLAVGDNRVLDMASTYFDSGSGSG | 506 |
| TAL16 | — | 17 | — | SGGSGSLQENLSGSGSG | 507 |
| TAL17 | — | 19 | — | SGGSGSGYTYINPSGSGSG | 508 |
| TAL18 | — | 26 | — | SGGSGSYKLPAVTTMKVRPASGSGSG | 509 |
| TAL19 | — | 16 | — | SGGSGSLEGSSGSGSG | 510 |
| TAL20 | — | 16 | — | SGGSGSIVEASGSGSG | 511 |
| TAL21 | — | 18 | — | SGGSGSQTYQPASGSGSG | 512 |
| TAL22 | — | 27 | — | SGGSGSIARTDLKKNRDYPLASGSGSG | 513 |
| TAL23 | — | 18 | — | SGGSGSLPEEKGSGSGSG | 514 |
| TAL24 | — | 16 | — | SGGSGSYTSTSGSGSG | 515 |
| TAL25 | — | 20 | — | SGGSGSSRPSESEGSGSGSG | 516 |
| TAL26 | — | 17 | — | SGGSGSLGNSLSGSGSG | 517 |

TABLE 34-continued

List of peptide linkers that can be used in MBBBD proteins.

| Name (PDB) | Amino Acids | Size | Length | Sequence | SEQ ID NO |
|---|---|---|---|---|---|
| TAL27 | — | 19 | — | SGGSGSLTKYKSSSGSGSG | 518 |
| TAL28 | — | 33 | — | SGGSGSTEEPGAPLTTPPTLHGNQARASGSGSG | 519 |
| TAL29 | — | 18 | — | SGGSGSFSHSTTSGSGSG | 520 |
| TAL30 | — | 20 | — | SGGSGSPELKQKSSSGSGSG | 521 |
| TAL31 | — | 40 | — | SGGSGSILNKEKKAVSPLLLTTTNSSEGLSMGNYSGSGSG | 522 |
| TAL32 | — | 31 | — | ELAEFHARYADLLLRDLRERPVSLVRGPDSG | 523 |
| TAL33 | — | 31 | — | ELAEFHARPDPLLLRDLRERPVSLVRGLGSG | 524 |
| TAL34 | — | 26 | — | ELAEFHARYADLLLRDLRERSGSGSG | 525 |
| TAL35 | — | 31 | — | DIFDYYAGVAEVMLGHIAGRPATRKRWPNSG | 526 |
| TAL36 | — | 31 | — | DIFDYYAGPDPVMLGHIAGRPATRKRWLGSG | 527 |
| TAL37 | — | 26 | — | DIFDYYAGVAEVMLGHIAGRSGSGSG | 528 |
| Linker A | | 37 | | SIVAQLSRPDPALVSFQKLKLACLGGRPALDAVKKGL | 529 |
| Linker B | | 37 | | SIVAQLSRPDPAAVSAQKAKAACLGGRPALDAVKKGL | 530 |
| Linker C | | 37 | | SIVAQLSRPDPAVVTFHKLKLACLGGRPALDAVKKGL | 531 |
| Linker D | | 44 | | SIVAQLSRPDPAQSLAQELSLNESQIKIACLGGRPALDAVKKGL | 532 |
| Linker E | | 40 | | SIVAQLSRPDPALQLPPLERLTLDACLGGRPALDAVKKGL | 533 |
| Linker F | | 38 | | SIVAQLSRPDPAIHKKFSSIQMACLGGRPALDAVKKGL | 534 |
| Linker G | | 40 | | SIVAQLSRPDPAAAAATNDHAVAAACLGGRPALDAVKKGL | 535 |

REFERENCES

Arnould, S., P. Chames, et al. (2006). "Engineering of large numbers of highly specific homing endonucleases that induce recombination on novel DNA targets." *J Mol Biol* 355(3): 443-58.

Arnould, S., C. Delenda, et al. (2011). "The I-CreI meganuclease and its engineered derivatives: applications from cell modification to gene therapy." *Protein Eng Des Sel* 24(1-2): 27-31.

Baker, M. (2012). "Gene-editing nucleases." *Nat Methods* 9(1): 23-6.

Boch, J., H. Scholze, et al. (2009). "Breaking the code of DNA binding specificity of TAL-type III effectors." *Science* 326(5959): 1509-12.

Bogdanove, A. J. and D. F. Voytas (2011). "TAL effectors: customizable proteins for DNA targeting." *Science* 333(6051): 1843-6.

Bustos, S. A. and R. F. Schleif (1993). "Functional domains of the AraC protein." *Proc Natl Acad Sci USA* 90(12): 5638-42.

Cermak, T., E. L. Doyle, et al. (2010). "Efficient design and assembly of custom TALEN and other TAL effector-based constructs for DNA targeting." *Nucleic Acids Res* 39(12): e82.

Chames, P., J. C. Epinat, et al. (2005). "In vivo selection of engineered homing endonucleases using double-strand break induced homologous recombination." *Nucleic Acids Res* 33(20): e178.

Christian, M., T. Cermak, et al. (2010). "Targeting DNA double-strand breaks with TAL effector nucleases." *Genetics* 186(2): 757-61.

Critchlow, S. E. and S. P. Jackson (1998). "DNA end-joining: from yeast to man." *Trends Biochem Sci* 23(10): 394-8.

Deng, D., C. Yan, et al. (2012). "Structural basis for sequence-specific recognition of DNA by TAL effectors." *Science* 335(6069): 720-3.

Doyle, E. L., N. J. Booher, et al. (2012). "TAL Effector-Nucleotide Targeter (TALE-NT) 2.0: tools for TAL effector design and target prediction." *Nucleic Acids Res* 40(Web Server issue): W117-22.

Epinat, J. C., S. Arnould, et al. (2003). "A novel engineered meganuclease induces homologous recombination in yeast and mammalian cells." *Nucleic Acids Res* 31(11): 2952-62.

Geissler, R., H. Scholze, et al. (2011). "Transcriptional activators of human genes with programmable DNA-specificity." *PLoS One* 6(5): e19509.

Grizot, S., J. C. Epinat, et al. "Generation of redesigned homing endonucleases comprising DNA-binding domains derived from two different scaffolds." *Nucleic Acids Res* 38(6): 2006-18.

Huang, P., A. Xiao, et al. (2011). "Heritable gene targeting in zebrafish using customized TALENs." *Nat Biotechnol* 29(8): 699-700.

Kim, Y. G., J. Cha, et al. (1996). "Hybrid restriction enzymes: zinc finger fusions to Fok I cleavage domain." *Proc Natl Acad Sci USA* 93(3): 1156-60.

Lackner, G., N. Moebius, et al. (2011). "Complete genome sequence of *Burkholderia rhizoxinica*, an Endosymbiont of *Rhizopus microsporus.*" *J Bacteriol* 193(3): 783-4.

Li, L., M. J. Piatek, et al. (2012). "Rapid and highly efficient construction of TALE-based transcriptional regulators and nucleases for genome modification." *Plant Mol Biol* 78(4-5): 407-16.

Li, L., L. P. Wu, et al. (1992). "Functional domains in Fok I restriction endonuclease." *Proc Natl Acad Sci USA* 89(10): 4275-9.

Li, T., S. Huang, et al. (2011). "TAL nucleases (TALNs): hybrid proteins composed of TAL effectors and FokI DNA-cleavage domain." *Nucleic Acids Res* 39(1): 359-72.

Ma, J. L., E. M. Kim, et al. (2003). "Yeast Mre11 and Rad1 proteins define a Ku-independent mechanism to repair double-strand breaks lacking overlapping end sequences." *Mol Cell Biol* 23(23): 8820-8.

Mahfouz, M. M., L. Li, et al. (2012). "Targeted transcriptional repression using a chimeric TALE-SRDX repressor protein." *Plant Mol Biol* 78(3): 311-21.

Mahfouz, M. M., L. Li, et al. (2011). "De novo-engineered transcription activator-like effector (TALE) hybrid nuclease with novel DNA binding specificity creates double-strand breaks." *Proc Natl Acad Sci USA*.

Mak, A. N., P. Bradley, et al. (2012). "The crystal structure of TAL effector PthXo1 bound to its DNA target." *Science* 335(6069): 716-9.

Miller, J. C., S. Tan, et al. (2011). "A TALE nuclease architecture for efficient genome editing." *Nat Biotechnol*.

Morbitzer, R., J. Elsaesser, et al. (2011). "Assembly of custom TALE-type DNA binding domains by modular cloning." *Nucleic Acids Res* 39(13): 5790-9.

Moscou, M. J. and A. J. Bogdanove (2009). "A simple cipher governs DNA recognition by TAL effectors." *Science* 326(5959): 1501.

Mussolino, C., R. Morbitzer, et al. (2011). "A novel TALE nuclease scaffold enables high genome editing activity in combination with low toxicity." *Nucleic Acids Res* 39(21): 9283-93.

Sander, J. D., L. Cade, et al. (2011). "Targeted gene disruption in somatic zebrafish cells using engineered TAL-ENs." *Nat Biotechnol* 29(8): 697-8.

Smith, J., S. Grizot, et al. (2006). "A combinatorial approach to create artificial homing endonucleases cleaving chosen sequences." *Nucleic Acids Res* 34(22): e149.

Smith, J., S. Grizot, et al. (2006). "A combinatorial approach to create artificial homing endonucleases cleaving chosen sequences." *Nucleic Acids Res.*

Stoddard, B. L., R. J. Monnat, et al. (2007). "Advances in engineering homing endonucleases for gene targeting: ten years after structures." *Progress in Gene Therapy: AUtoloqous:* 135-167.

Tesson, L., C. Usal, et al. (2011). "Knockout rats generated by embryo microinjection of TALENs." *Nat Biotechnol* 29(8): 695-6.

Weber, E., R. Gruetzner, et al. (2011). "Assembly of designer TAL effectors by Golden Gate cloning." *PLoS One* 6(5): e19722.

Zhang, F., L. Cong, et al. (2011). "Efficient construction of sequence-specific TAL effectors for modulating mammalian transcription." *Nat Biotechnol* 29(2): 149-53.

SEQUENCE LISTING (559 sequences)

SEQ ID NO: 1 - protein, 797 aa, Artificial sequence
  Description of artificial sequence: synthetic polypeptide: Avrbs3CLS
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPALAALTNDHLVALACLGGRPALDAVKKGL

SEQ ID NO: 2 - protein, 771 aa, burkholderia rhizoxinica
  E5AV36_BURRH
MSTAFVDQDKQMANRLNLSPLERSKIEKQYGGATTLAFISNKQNELAQILSRADILKIASYDCAAHALQAVLDCGPMLGKRGFSQSDIVKIAGNIGGAQALQAVLDLESMLGKRGFSRDDIAKMAGNIGGAQTLQAVLDLESAFRERGFSQADIVKIAGNNGGAQALYSVLDVEPTLGKRGFSRADIVKIAGNTGGAQALHTVLDLEPALGKRGFSRIDIVKIAANNGGAQALHAVLDLGPTLRECGFSQATIAKIAGNIGGAQALQMVLDLGPALGKRGFSQATIAKIAGNIGGAQALQTVLDLEPALCERGFSQATIAKMAGNNGGAQALQTVLDLEPALRKRDFRQADIIKIAGNDGGAQALQAVIEHGPTLRQHGFNLADIVKMAGNIGGAQALQAVLDLKPVLDEHGFSQPDIVKMAGNIGGAQALQAVLSLGPALRERGFSQPDIVKIAGNTGGAQALQAVLDLELTLVEHGFSQPDIVRITGNRGGAQALQAVLALELTLRERGFSQPDIVKIAGNSGGAQALQAVLDLELTFRERGFSQADIVKIAGNDGGTQALHAVLDLERMLGERGFSRADIVNVAGNNGGAQALKAVLEHEATLNERGFSRADIVKIAGNGGGAQALKAVLEHEATLDERGFSRADIVRIAGNGGGAQALKAVLEHGPTLNERGFNLTDIVEMAANSGGAQALKAVLEHGPTLRQRGLSLIDIVEIASNGGAQALKAVLKYGPVLMQAGRSNEEIVHVAARRGGAGRIRKMVAPLLERQ

SEQ ID NO: 3 - protein, 310 aa, burkholderia rhizoxinica
MPVTSVYQKDKPFGARLNLSPFECLKIEKHSGGADALEFISNKYDALTQVLSRADILKIACHDCAAHALQAVLDYEQVFRQRGFARADIIKITGNGGGAQALKAVVVHGPTLNECGFSQADIVRIADNIGAQALKAVLEHGPTLNERDYSGADIVKIAGNGGGARALKAVVMHGPTLCESGYSGADIVKIASNGGGAQALEAVAMHGSTLCERGYCRTDIAKIAGNGGGAQALKAIVMHGPTLCERGYSRTDIVKIADNNGGAQALKAVFEHGPALTQAGRSNEDIVNMAARTGAAGQIRKMAAQLSGRQ

SEQ ID NO: 4 - protein, 997 aa, burkholderia rhizoxinica
MPATSMHQEDKQSANGLNLSPLERIKIEKHYGGGATLAFISNQHDELAQVLSRADILKIASYDCAAQALQAVLDCGPMLGKRGFSRADIVRIAGNGGGAQALYSVLDVEPTLGKRGFSQVDVVKIAGGGAQALHTVLEIGPTLGERGFSRGDIVTIAGNNGGAQALQAVLELEPTLRERGFNQADIVKIAGNGGGAQALQAVLDVEPALGKRGFSRVDIAKIAGGGAQALQAVLGLEPTLRKRGFHPTDIIKIAGNNGGAQALQAVLDLELMLRERGFSQADIVKMASNIGGAQALQAVLNLEPALCERGFSQPDIVKMAGNSGGAQALQAVLDLELAFRERGFSQADIVKMASNIGGAQALQAVLELEPALHERGFSQANIVKMAGNSGGAQALQAVLDLELVFRERGFSQPEIVEMAGNIGGAQALHTVLDLELAFRERGVRQADIVKIVGNNGGAQALQAVFELEPTLRERGFNQATIVKIAANGGGAQALYSVLDVEPTLDKRGFSRVDIVKIAGGGAQALHTAFELEPTLRKRGFNPTDIVKIAGNKGGAQALQAVLELEPALRERGFNQATIVKMAGNAGGAQALYSVLDVEPALRERGFSQPEIVKIAGNIGGAQALHTVLELEPTLHKRGFNPTDIVKIAGNSGGAQALQAVLELEPAFRERGFGQPDIVKMASNIGGAQALQAVLELEPALRERGFSQPDIVEMAGNIGGAQALQAVLELEPAFRERGFSQSDIVKIAGNIGGAQALQAVLELEPTLRESDFRQADIVNIAGNDGSTQALKAVIEHGPRLRQRGFNRASIVKIAGNSGGAQALQAVLKHGPTLDERGFNLTNIVKIAGNGGGAQALKAVIEHGPTLQQRGFNLTDIVEMAGKGGGAQALKAVLEHGPTLRQRGFNLIDIVEMASNTGGAQALKTVLEHGPTLRQRDLSLIDIVEIASNGGAQALKAVLKYGPVLMQAGRSNEEIVHVAARRGGAGRIRKMVALLLERQ

SEQ ID NO: 5 - protein, 63 aa, burkholderia rhizoxinica
MQAVLDCGPMLSKRGFSQADIVKIACNGGAQALYSVLDVEPTLRERGFSRVDIVKIAGNNGGA

SEQ ID NO: 6 - protein, 287 aa, burkholderia rhizoxinica
DPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLN

SEQ ID NO: 7 - protein, 82 aa, burkholderia rhizoxinica
MSTAFVDQDKQMANRLNLSPLERSKIEKQYGGATTLAFISNKQNELAQILSRADILKIASYDCAAHALQAVLDCGPMLGKRG

SEQ ID NO: 8 - protein, 83 aa, burkholderia rhizoxinica
MPVTSVYQKDKPFGARLNLSPFECLKIEKHSGGADALEFISNKYDALTQVLSRADILKIACHDCAAHALQAVLDYEQVFRQRG

SEQ ID NO: 9 - protein, 83 aa, burkholderia rhizoxinica
MPATSMHQEDKQSANGLNLSPLERIKIEKHYGGGATLAFISNQHDELAQVLSRADILKIASYDCAAQALQAVLDCGPMLGKRG

SEQ ID NO: 10 - protein, 34 aa, Xanthomonas oryzae
LTPEQVVAIASHGGGKQALETVQRLLPVLCQAHG

SEQ ID NO: 11 - protein, 33 aa, burkholderia rhizoxinica
FSQSDIVKIAGNIGGAQALQAVLDLESMLGKRG

SEQ ID NO: 12 - protein, 33 aa, burkholderia rhizoxinica
FSRDDIAKMAGNIGGAQTLQAVLDLESAFRERG

SEQ ID NO: 13 - protein, 33 aa, burkholderia rhizoxinica
FSQADIVKIAGNNGGAQALYSVLDVEPTLGKRG

SEQ ID NO: 14 - protein, 33 aa, burkholderia rhizoxinica
FSRADIVKIAGNTGGAQALHTVLDLEPALGKRG

SEQ ID NO: 15 - protein, 33 aa, burkholderia rhizoxinica
FSRIDIVKIAANNGGAQALHAVLDLGPTLRECG

SEQ ID NO: 16 - protein, 33 aa, burkholderia rhizoxinica
FSQATIAKIAGNIGGAQALQMVLDLGPALGKRG

SEQ ID NO: 17 - protein, 33 aa, burkholderia rhizoxinica
FSQATIAKIAGNIGGAQALQTVLDLEPALCERG

SEQ ID NO: 18 - protein, 33 aa, burkholderia rhizoxinica
FSQATIAKMAGNNGGAQALQTVLDLEPALRKRD

SEQ ID NO: 19 - protein, 33 aa, burkholderia rhizoxinica
FRQADIIKIAGNDGGAQALQAVIEHGPTLRQHG

SEQ ID NO: 20 - protein, 33 aa, burkholderia rhizoxinica
FNLADIVKMAGNIGGAQALQAVLDLKPVLDEHG

SEQ ID NO: 21 - protein, 33 aa, burkholderia rhizoxinica
FSQPDIVKMAGNIGGAQALQAVLSLGPALRERG

SEQ ID NO: 22 - protein, 33 aa, burkholderia rhizoxinica
FSQPDIVKIAGNTGGAQALQAVLDLELTLVEHG

SEQ ID NO: 23 - protein, 33 aa, burkholderia rhizoxinica
FSQPDIVRITGNRGGAQALQAVLALELTLRERG

SEQ ID NO: 24 - protein, 33 aa, burkholderia rhizoxinica
FSQPDIVKIAGNSGGAQALQAVLDLELTFRERG

SEQ ID NO: 25 - protein, 33 aa, burkholderia rhizoxinica
FSQADIVKIAGNDGGTQALHAVLDLERMLGERG

SEQ ID NO: 26 - protein, 33 aa, burkholderia rhizoxinica
FSRADIVNVAGNNGGAQALKAVLEHEATLNERG

SEQ ID NO: 27 - protein, 33 aa, burkholderia rhizoxinica
FSRADIVKIAGNGGGAQALKAVLEHEATLDERG

SEQ ID NO: 28 - protein, 33 aa, burkholderia rhizoxinica
FSRADIVRIAGNGGGAQALKAVLEHGPTLNERG

SEQ ID NO: 29 - protein, 33 aa, burkholderia rhizoxinica
FNLTDIVEMAANSGGAQALKAVLEHGPTLRQRG

SEQ ID NO: 30 - protein, 32 aa, burkholderia rhizoxinica
LSLIDIVEIASNGGAQALKAVLKYGPVLMQAG

SEQ ID NO: 31 - protein, 33 aa, burkholderia rhizoxinica
FARADIIKITGNGGGAQALKAVVVHGPTLNECG

SEQ ID NO: 32 - protein, 33 aa, burkholderia rhizoxinica; identical to SEQ ID NO: 31

SEQ ID NO: 33 - protein, 33 aa, burkholderia rhizoxinica
YSGADIVKIAGNGGGARALKAVVMHGPTLCESG

SEQ ID NO: 34 - protein, 33 aa, burkholderia rhizoxinica
YSGADIVKIASNGGGAQALEAVAMHGSTLCERG

SEQ ID NO: 35 - protein, 33 aa, burkholderia rhizoxinica
YCRTDIAKIAGNGGGAQALKAIVMHGPTLCERG

SEQ ID NO: 36 - protein, 33 aa, burkholderia rhizoxinica
YSRTDIVKIADNNGGAQALKAVFEHGPALTQAG

SEQ ID NO: 37 - protein, 33 aa, burkholderia rhizoxinica
FSRADIVRIAGNGGGAQALYSVLDVEPTLGKRG

SEQ ID NO: 38 - protein, 31 aa, burkholderia rhizoxinica
FSQVDVVKIAGGGAQALHTVLEIGPTLGERG

SEQ ID NO: 39 - protein, 33 aa, burkholderia rhizoxinica
FSRGDIVTIAGNNGGAQALQAVLELEPTLRERG

SEQ ID NO: 40 - protein, 33 aa, burkholderia rhizoxinica
FNQADIVKIAGNGGGAQALQAVLDVEPALGKRG

SEQ ID NO: 41 - protein, 31 aa, burkholderia rhizoxinica
FSRVDIAKIAGGGAQALQAVLGLEPTLRKRG

SEQ ID NO: 42 - protein, 33 aa, burkholderia rhizoxinica
FHPTDIIKIAGNNGGAQALQAVLDLELMLRERG

SEQ ID NO: 43 - protein, 33 aa, burkholderia rhizoxinica
FSQADIVKMASNIGGAQALQAVLNLEPALCERG

SEQ ID NO: 44 - protein, 33 aa, burkholderia rhizoxinica
FSQPDIVKMAGNSGGAQALQAVLDLELAFRERG

SEQ ID NO: 45 - protein, 33 aa, burkholderia rhizoxinica
FSQADIVKMASNIGGAQALQAVLELEPALHERG

SEQ ID NO: 46 - protein, 33 aa, burkholderia rhizoxinica
FSQANIVKMAGNSGGAQALQAVLDLELVFRERG

SEQ ID NO: 47 - protein, 33 aa, burkholderia rhizoxinica
FSQPEIVEMAGNIGGAQALHTVLDLELAFRERG

SEQ ID NO: 48 - protein, 33 aa, burkholderia rhizoxinica
VRQADIVKIVGNNGGAQALQAVFELEPTLRERG

SEQ ID NO: 49 - protein, 33 aa, burkholderia rhizoxinica
FNQATIVKIAANGGGAQALYSVLDVEPTLDKRG

SEQ ID NO: 50 - protein, 31 aa, burkholderia rhizoxinica
FSRVDIVKIAGGGAQALHTAFELEPTLRKRG

SEQ ID NO: 51 - protein, 33 aa, burkholderia rhizoxinica
FNPTDIVKIAGNKGGAQALQAVLELEPALRERG

SEQ ID NO: 52 - protein, 33 aa, burkholderia rhizoxinica
FNQATIVKMAGNAGGAQALYSVLDVEPALRERG

SEQ ID NO: 53 - protein, 33 aa, burkholderia rhizoxinica
FSQPEIVKIAGNIGGAQALHTVLELEPTLHKRG

SEQ ID NO: 54 - protein, 33 aa, burkholderia rhizoxinica
FNPTDIVKIAGNSGGAQALQAVLELEPAFRERG

SEQ ID NO: 55 - protein, 33 aa, burkholderia rhizoxinica
FGQPDIVKMASNIGGAQALQAVLELEPALRERG

SEQ ID NO: 56 - protein, 33 aa, burkholderia rhizoxinica
FSQPDIVEMAGNIGGAQALQAVLELEPAFRERG

SEQ ID NO: 57 - protein, 33 aa, burkholderia rhizoxinica
FSQSDIVKIAGNIGGAQALQAVLELEPTLRESD

SEQ ID NO: 58 - protein, 33 aa, burkholderia rhizoxinica
FRQADIVNIAGNDGSTQALKAVIEHGPRLRQRG

SEQ ID NO: 59 - protein, 32 aa, burkholderia rhizoxinica
FNRAIVKIAGNSGGAQALQAVLKHGPTLDERG

SEQ ID NO: 60 - protein, 33 aa, burkholderia rhizoxinica
FNLTNIVKIAGNGGGAQALKAVIEHGPTLQQRG

SEQ ID NO: 61 - protein, 33 aa, burkholderia rhizoxinica
FNLTDIVEMAGKGGGAQALKAVLEHGPTLRQRG

SEQ ID NO: 62 - protein, 33 aa, burkholderia rhizoxinica
FNLIDIVEMASNTGGAQALKTVLEHGPTLRQRD

SEQ ID NO: 63 - protein, 32 aa, burkholderia rhizoxinica; identical to SEQ ID NO: 30

SEQ ID NO: 64 - protein, 30 aa, burkholderia rhizoxinica
RSNEEIVHVAARRGGAGRIRKMVAPLLERQ

SEQ ID NO: 65 - protein, 30 aa, burkholderia rhizoxinica
RSNEDIVNMAARTGAAGQIRKMAAQLSGRQ

SEQ ID NO: 66 - protein, 30 aa, burkholderia rhizoxinica
RSNEEIVHVAARRGGAGRIRKMVALLLERQ

SEQ ID NO: 67 - protein, 328 aa, Unknown
  marine organisms metagenomic database
MRVLCRWCHMGGGSKNLVAVQANYAALTGLGFRTEGIVQMVSHGGGSKNLVAVQANYAALTGLGFRTEDIVQMVSHDGGSKNLVAVQANYAALTGLGFRTEDIVQMVSHDGGSKNLAIIDKSTALTGLGFRTEDIVQMVSNNGGSKNLAAIIDKSTALKGLGFRTEDIVQMVSHGGGSKNLEVVQANYAALTGLGFRTEGIVQMVSHGGGSKNLVAVQANYAALTGLGFRTEDIVQMVSHDGGSKNLAAMIDKYTALKDLGFRTEDIVQMVSHDGGSKNLAAIIDKSTALKGLGFLTEDIVQMVSHDGGSKNLEVVQASYDTLTELKF

SEQ ID NO: 68 - protein, 247 aa, Unknown
  marine organisms metagenomic database
MDKNAILKISICNGAHLAITTLLENWDALIDLELEPKDIVSIASHGGATQAITTLLNKWDDLRDKGLEPKDIVSIASNNGATQAIATLLAKWDSLIAKGLQPKDIVSIASHGGATQAITTLLNRWGDLRAKELEPKDIVSIASHDGATQAITTLLEKWDELRAKGLEPKDIVSIASHIGANQTITTLLNKWGALIDLELEPKDIVSIASHGGANKAITTLLEKWAALRAKELEPKDIVSIASHNGAT

SEQ ID NO: 69 - protein, 296 aa, Unknown
  marine organisms metagenomic database
VGDLRAKELEPKDIVSIASNTGANKTITRLLEKWGDLRAKELEPKDIVSIASHDGSNQTITKLLEKWDELRAKGLEPKDIVSIASHIGANQTITTLLNKWGALIDLELEPKDIVSIASHIGATQAITTLLNKWAALRAKGLDPKDIVSIASHDGSNQTITKLLEKWDELRAKELESKDIVSIASNNGATQTITRLLEKWDELRAKGLDPKDIVSIASHGGATQAITTLLNRWGDLIDLELEPKDIVSIASHKGANQVITTLLEKWDDLISQAYTKSSIVSIASTQNGVLGLLEALG

SEQ ID NO: 70 - protein, 224 aa, Unknown
  marine organisms metagenomic database
MINLYFARSFVFMSNQTEQKILKFKLELRYPTESAQLIRAGFNRDQADRIILRGSSQRTVAKLLEIHKTLLAHPYRITYDDLTRIAARNGGSKNLVAVQANYAALTELGFSAKDIVQMVSHGGGSKNLEVVQANYAALTGLGFRTEDIVQMVSHDGGSKNLAAMIDKSTALKDLGFRTEDIVQMVSHDGSSKNLAAMIDKSTALKGLGFRTEGIVQMVSHGWRL

SEQ ID NO: 71 - protein, 143 aa, Unknown
  marine organisms metagenomic database
WSNKAITTLLENWEKLIKKGLKPEDIVTIASHHGGSQAITTLLENWDDLLKLELKFEDIVSIASHNGASQAITTLLENWEKLIKKGLKPEDIVSIASHSGGSQAITTLLENWDDLIDQEYTESEIVNIFSSQDGVLKLLAELD

SEQ ID NO: 72 - protein, 595 aa, Unknown
  marine organisms metagenomic database
MINLYFARSFVFMSNQTEQKILKFKLELRYPTESAQLIRAGFNRDQADRIILRGSSQRTVAKLLEIHKTLLAHPYRITYDDLTRIAARNGGSKNLVAVQANYAALTELGFSAKDIVQMVSHGGGSKNLEVVQANYAALTGLGFRTEDIVQMVSHDGGSKNLAAMIDKSTALKDLGFRTEDIVQMVSHDGSSKNLAAMIDKSTALKGLGFRTEGIVQMVSHGGSSKNLAAMIDKSTALKGLGFRTEGIVQMVSHGGGSKNLVAVQANYAALTGLGFRTEGIVQMVSHGGGSKNLVAVQANYAALTGLGFRTEDIVQMVSHDGGSKNLVAVQANYAALTGLGFRTEDIVQMVSHDGGSKNLVAIIDKSTALKGLGFRTEDIVQMVSNNGGSKNLAAIIDKSTALKGLGFRTEDIVQMVSHGGGSKNLEVVQANYAALTGLGFRTEGIVQMVSHGGGSKNLVAVQANYAALTGLGFRTEDIVQMVSHDGGSKNLAAMIDKYTALKDLGFRTEDIVQMVSHDGGSKNLAAIIDKSTALKGLGFLTEDIVQMVSHDGGSKNLEVVQASYAALTGLGYTKSSIVSIASTQNGVLGLLEALG

SEQ ID NO: 73 - protein, 552 aa, Unknown
  marine organisms metagenomic database
MDKNAILKISICNGAHLAITTLLENWDALIDLELEPKDIVSIASHGGATQAITTLLNKWDDLRDKGLEPKDIVSIASNNGATQAIATLLAKWDSLIAKGLQPKDIVSIASHGGATQAITTLLNRWGDLRAKELEPKDIVSIASHDGATQAITTLLEKWDELRAKGLEPKDIVSIASHIGANQTITTLLNKWGALIDLELEPKDIVSIASHGGANKAITTLLEKWAALRAKELEPKDIVSIASHNGATQAITTLLEKWGDLRAKELEPKDIVSIASNTGANKTITRLLEKWGDLRAKELEPKDIVSIASHDGSNQTITKLLEKWDELRAKGLEPKDIVSIASHIGANQTITTLLNKWGALIDLELEPKDIVSIASHIGATQAITTLLNKWAALRAKGLDPKDIVSIASHDGSNQTITKLLEKWDELRAKELESKDIVSIASNNGATQTITRLLEKWDELRAKGLDPKDIVSIASHGGATQAITTLLNRWGDLIDLELEPKDIVSIASHKGANQVITTLLEKWDDLISQGYTKSSIVSIASTQNGVLGLLEALG

SEQ ID NO: 74 - protein, 66 aa, Unknown
  marine organisms metagenomic database
MDKNAILKISICNGAHLAITTLLENWDALIDLELEPKDIVSIASHGGATQAITTLLNKWDDLRDKG

SEQ ID NO: 75 - protein, 76 aa, Unknown
  marine organisms metagenomic database
MINLYFARSFVFMSNQTEQKILKFKLELRYPTESAQLIRAGFNRDQADRIILRGSSQRTVAKLLEIHKTLLAHPYR

SEQ ID NO: 76 - protein, 20 aa, Unknown
  marine organisms metagenomic database
WSNKAITTLLENWEKLIKKG

SEQ ID NO: 77 - protein, 33 aa, Unknown
  marine organisms metagenomic database
LEPKDIVSIASNNGATQAIATLLAKWDSLIAKG

SEQ ID NO: 78 - protein, 33 aa, Unknown
  marine organisms metagenomic database
LQPKDIVSIASHGGATQAITTLLNRWGDLRAKE

SEQ ID NO: 79 - protein, 33 aa, Unknown
  marine organisms metagenomic database
LEPKDIVSIASHDGATQAITTLLEKWDELRAKG

SEQ ID NO: 80 - protein, 33 aa, Unknown
  marine organisms metagenomic database
LEPKDIVSIASHIGANQTITTLLNKWGALIDLE

SEQ ID NO: 81 - protein, 33 aa, Unknown
  marine organisms metagenomic database
LEPKDIVSIASHGGANKAITTLLEKWAALRAKE

SEQ ID NO: 82 - protein, 33 aa, Unknown
  marine organisms metagenomic database
LEPKDIVSIASHNGATQAITTLLEKWGDLRAKE

SEQ ID NO: 83 - protein, 33 aa, Unknown
  marine organisms metagenomic database
LEPKDIVSIASNTGANKTITRLLEKWGDLRAKE

SEQ ID NO: 84 - protein, 33 aa, Unknown
  marine organisms metagenomic database
LEPKDIVSIASHDGSNQTITKLLEKWDELRAKG

SEQ ID NO: 85 - protein, 33 aa, Unknown; identical to SEQ ID NO: 80
  marine organisms metagenomic database

SEQ ID NO: 86 - protein, 33 aa, Unknown
  marine organisms metagenomic database
LEPKDIVSIASHIGATQAITTLLNKWAALRAKG

SEQ ID NO: 87 - protein, 33 aa, Unknown
  marine organisms metagenomic database
LDPKDIVSIASHDGSNQTITKLLEKWDELRAKE

SEQ ID NO: 88 - protein, 33 aa, Unknown
  marine organisms metagenomic database
LESKDIVSIASNNGATQTITRLLEKWDELRAKG

SEQ ID NO: 89 - protein, 33 aa, Unknown
  marine organisms metagenomic database
LDPKDIVSIASHGGATQAITTLLNRWGDLIDLE

SEQ ID NO: 90 - protein, 33 aa, Unknown
  marine organisms metagenomic database
LEPKDIVSIASHKGANQVITTLLEKWDDLISQA

SEQ ID NO: 91 - protein, 33 aa, Unknown
  marine organisms metagenomic database
ITYDDLTRIAARNGGSKNLVAVQANYAALTELG

SEQ ID NO: 92 - protein, 33 aa, Unknown
  marine organisms metagenomic database
FSAKDIVQMVSHGGGSKNLEVVQANYAALTGLG

SEQ ID NO: 93 - protein, 33 aa, Unknown
  marine organisms metagenomic database
FRTEDIVQMVSHDGGSKNLAAMIDKSTALKDLG

SEQ ID NO: 94 - protein, 33 aa, Unknown
  marine organisms metagenomic database
FRTEDIVQMVSHDGSSKNLAAMIDKSTALKGLG

SEQ ID NO: 95 - protein, 33 aa, Unknown
  marine organisms metagenomic database
FRTEGIVQMVSHGGSSKNLAAMIDKSTALKGLG

SEQ ID NO: 96 - protein, 33 aa, Unknown
  marine organisms metagenomic database
FRTEGIVQMVSHGGGSKNLVAVQANYAALTGLG

SEQ ID NO: 97 - protein, 33 aa, Unknown; identical to SEQ ID NO: 96
  marine organisms metagenomic database

SEQ ID NO: 98 - protein, 33 aa, Unknown
  marine organisms metagenomic database
FRTEDIVQMVSHDGGSKNLVAVQANYAALTGLG

SEQ ID NO: 99 - protein, 33 aa, Unknown
  marine organisms metagenomic database
FRTEDIVQMVSHDGGSKNLVAIIDKSTALKGLG

SEQ ID NO: 100 - protein, 33 aa, Unknown
  marine organisms metagenomic database
FRTEDIVQMVSNNGGSKNLAAIIDKSTALKGLG

SEQ ID NO: 101 - protein, 33 aa, Unknown
  marine organisms metagenomic database
FRTEDIVQMVSHGGGSKNLEVVQANYAALTGLG

SEQ ID NO: 102 - protein, 33 aa, Unknown; identical to SEQ ID NO: 96
  marine organisms metagenomic database

SEQ ID NO: 103 - protein, 33 aa, Unknown
  marine organisms metagenomic database
FRTEDIVQMVSHDGGSKNLAAMIDKYTALKDLG

SEQ ID NO: 104 - protein, 33 aa, Unknown
  marine organisms metagenomic database
FRTEDIVQMVSHDGGSKNLAAIIDKSTALKGLG

SEQ ID NO: 105 - protein, 33 aa, Unknown
  marine organisms metagenomic database
FLTEDIVQMVSHDGGSKNLEVVQASYAALTGLG

SEQ ID NO: 106 - protein, 33 aa, Unknown
  marine organisms metagenomic database
LKPEDIVTIASHHGGSQAITTLLENWDDLLKLE

SEQ ID NO: 107 - protein, 33 aa, Unknown
  marine organisms metagenomic database
LKFEDIVSIASHNGASQAITTLLENWEKLIKKG

SEQ ID NO: 108 - protein, 33 aa, Unknown
  marine organisms metagenomic database
LKPEDIVSIASHSGGSQAITTLLENWDDLIDQE

SEQ ID NO: 109 - protein, 24 aa, Unknown
  marine organisms metagenomic database
YTESEIVNIFSSQDGVLKLLAELD

SEQ ID NO: 110 - protein, 24 aa, Unknown
  marine organisms metagenomic database
YTKSSIVSIASTQNGVLGLLEALG

SEQ ID NO: 111 - protein, 278 aa, Xanthomonas oryzae
SIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDQTRASSRKRSRSDRAVTGPSAQQSFEVRVPEQRDALHLPLSWRVKRPRTSIGGGLPDPGTPTAADLAASSTVMREQDEDPFAGAADDFPAFNEEELAWLMELLPQ

SEQ ID NO: 112 - DNA, 2994 bp, burkholderia rhizoxinica
atgccggcgacgtctatgcatcaagaagacaagcaatcggctaacgggcttaacctcagcccactcgaacgcataaagattgagaaacattatggtggtggtgccaccctggcgtttatctcaaatcagcacgatgagctcgctcaagtactgagtcgggctgatattttaaaaattgcaagctatgactgcgcagcccaggcgttgcaagcggtgctcgactgtgggccgatgcttggcaagcgcggcttcagccgagcggatatcgtcagaatcgcgggcaatggcggtggggcacaggcgctgtattcggtgcttgacgttgagccgacgctaggcaaacgtggtttcagccaggttgatgtcgttaaaattgcgggcggtggcgcgcaggcactgcatacagtgcttgaaattggcccgacgcttggcgaacgtggtttcagccggggcgatatcgtcacgattgcgggcaataacggcggggcgcaggcgttgcaggcggtgcttgagcttgagccgacgcttcgcgaacgcggcttcaaccaagccgacatcgttaaaatcgcgggcaatggcggtggagcgcaggcgctgcaggcggtgcttgacgttgagccggcgcttggcaaacgtggtttcagccgggttgatatcgctaaaatcgcgggcggtggggcgcaggcactgcaggcggtgcttggacttgagccgacgcttcgcaagcgtggcttccacccgaccgatattatcaaaattgcaggcaataacggtggggcgcaggcactgcaggcggtgcttgaccttgagctaatgcttcgcgagcgcggcttcagccaggccgatatcgtgaaaatggcgagcaatattggcggggcgcaggcactgcaggcggtgcttaaccttgagccagcgctttgcgagcgcggtttcagccagcccgatatcgtgaaaatggcgggcaatagtgggggggcgcaggcactgcaggcagtgcttgaccttgagttggcgtttcgcgagcgcggcttcagccaggccgatatcgtgaaaatggcgagcaatattggcggagcgcaggcactgcaggcggtgcttgagcttgagccagcgcttcacgagcgcggcttcagccaagccaatattgtcaaaatggccggcaatagtggtggggcgcaggcactgcaggcggtgcttgaccttgagctagtgtttcgcgagcgcggtttcagccaacccgagattgtcgaaatggcgggcaatatcggcggggcgcaggcactgcatacggtgcttgaccttgagctggcgtttcgcgagcggggcgtccgtcaggctgacatcgtcaagattgtaggcaataatggtggggcgcaggcactgcaggcagtgtttgaacttgagccgacgcttcgcgagcgcggcttcaaccaagccaccatcgtgaaaatagcggccaatggcggtggggcgcaggcgctgtattcggtgcttgacgttgagccgacgcttgacaaacgtggtttcagtcgggttgatatcgtaaaaatcgcgggcggtggcgcgcaggcactgcatacggcgtttgaacttgagccgacgcttcgtaagcgcggcttcaatccgaccgatattgtcaagattgcaggcaataaggggggagcgcaggcactgcaggcggtgcttgagcttgaaccagcgcttcgcgagcgcggcttcaaccaagccaccatcgtgaaaatggcgggcaatgccggtggggcgcaggcgttatattcggtgcttgacgttgagccagcgcttcgcgagcgcggtttcagccaacccgagattgtcaaaatcgcaggcaatatcggcggggcgcaggcactgcatacggtgcttgaacttgagccgacgcttcacaagcgcggcttcaatccgaccgatattgtcaagattgcaggcaatagtggtggcgcgcaggcactacaggcggtgcttgagcttgagccagcgtttcgcgagcgaggcttcggccagcccgatatcgtgaaaatggcgagcaatatcggcggggcgcaggcactgcaggcggtgcttgagcttgagccagcgcttcgcgagcgcggtttcagccaacccgatattgtcgaaatggcgggcaatatcggcggggcgcaggcactgcaggcggtgcttgagcttgagccagcgtttcgtgagcgcggcttcagccaatccgatattgtcaaaatcgcaggtaatatcggcggggcacaggcactgcaggcggtgcttgagcttgagccaacgcttcgcgagagtgacttccgtcaggcggacattgtcaacattgcgggcaacgatggcagtacccaggcgctgaaggcagtgatcgagcatgggccgagactgcgacagcgcggcttcaatcgagcgagtatcgtcaaaatcgcgggcaatagcggtggggcgcaagcactacaagcggtgctcaagcatgggccaacactggacgagcgcggcttcaatctgaccaatattgtcaaaatcgcgggcaatggcggcggcgcccaggcgctgaaagcagtgatcgagcatgggccaacactgcaacagcgcggcttcaatctaaccgatatcgtcgaaatggcaggcaaaggcggcggcgcccaggcgctgaaggcagtgctcgagcatgggccaacactgcgacagcgcggcttcaatctgatcgatatcgtcgaaatggcgagcaatactggtggagctcaggcgctgaagacggtgcttgagcatgggccgacgctgcggcaacgcgacttgagtctaatcgatatcgtggagattgcgagcaatggcggcgctcaggcgttgaaagcggtgctcaaatatgggccggtgctcatgcaggcaggacgctccaacgaggagatcgtacatgtggccgcgcgccgaggaggagccggtcgaatacgaaagatggtcgcactcttgctggagcggcaatag

SEQ ID NO: 113 - DNA, 2316 bp, burkholderia rhizoxinica
atgtcgacggcgttcgtggaccaagataaacaaatggctaaccggcttaatctcagcccgctcgaacgctcaaagattgagaaacaatatggtggtgctaccaccttggcgtttatctcaaataagcagaatgaactcgctcaaatactgagccgggctgacatcctaaaaatcgcaagctatgactgcgcagcccacgcgttgcaagcggtgctcgactgtgggccgatgcttggcaagcgcggcttcagccagtccgatatcgtgaaaatcgcgggcaatatcggtggagcacaggcactacaggcggtgcttgaccttgagtcgatgcttggcaaacgaggcttcagccgggacgatatcgctaagatggcgggcaatatcggtggggcacaaacactacaagcggtgcttgaccttgagtcggcgtttcgcgagcgcggtttcagccaagccgacatcgtgaaaatcgcgggcaataacggtggagcgcaggcgctgtattcggtgcttgacgttgagccgacgcttggtaagcgcggcttcagtcgagcggatattgtcaagattgcaggcaataccggtggggcgcaggcactgcatacggtgcttgacctcgagccggcgcttggcaaacgcggttttagccggatcgatatcgttaaaattgcggccaataatggtggggcgcaagcgctgcatgcagtgcttgaccttgggccgacgcttcgtgagtgcggctttagccaagccaccatcgcaaaaatcgcgggcaatatcggcggggcacaggcgctgcagatggtgcttgaccttgggccggcgcttggcaagcgcggtttcagccaagccaccatcgcgaaaatcgcgggcaatatcggcggagcgcaggcgctacagacggtgcttgatcttgagccggcgctttgcgagcgcggcttcagccaagccaccatcgcgaaaatggcgggcaataatggcggggcgcaggcgctgcagacggtgcttgaccttgagccggcgcttcgcaagcgcgacttccgtcaggctgacatcatcaagattgcgggcaacgatggcggggcacaggcgctgcaggcagtgattgagcatgggccgacgctgcggcaacacggcttcaatctggccgatatcgtgaaaatggcgggcaatatcggcggggctcaggcactgcaggcggtacttgaccttaagccggtgcttgacgagcacggtttcagccagcccgatattgtgaaaatggcaggtaatatcggcggggctcaggcactgcaggcggtgcttagtcttgggccggcgcttcgcgagcgcggcttcagccagcctgatatcgtgaaaattgcaggcaataccggtggggcgcaggcactgcaggcggtgcttgaccttgagctgacgcttgtcgaacacggcttcagtcagcctgatatcgtgagaataacgggcaatagaggtggggcgcaggcactgcaggcggtgcttgcccttgaactgacgcttcgcgagcgcggcttcagtcagcctgacattgtcaagattgcaggcaatagtggtggagcgcaggcactgcaggcggtgcttgaccttgaactgacgtttcgtgagcgcggcttcagtcaggctgacatcgtcaagatcgcaggcaacgatggtggaacccaggcgctgcatgcagtgcttgaccttgagcggatgcttggcgagcgcggtttcagtcgagcggatatcgtgaacgtcgcgggcaataacggtggcgcgcaagcgctgaaggcagtactcgaacatgaggcgacactgaacgagcgcggtttcagtcgagcggatatcgttaaaattgcgggcaatggcggtggggcgcaagcactgaaggcagtactcgagcatgaggcgacactggacgagcgcggcttcagtcgagcggatatcgtcagaatcgcgggcaatggcggcggcgcccaggcgctgaaagcggtgctcgagcatgggccgacactgaacgagcgcggcttcaatctgaccgatatcgtcgaaatggcggccaatagtggtggggctcaggcgctgaaggcggtgcttgagcatgggccgacactgcggcagcgcggcttgagtctaatcgatatcgtggagattgcgagcaatggcggcgcccaggcgttgaaagcggtgctcaaatatgggccggtgctcatgcaggcaggacgctccaacgaggagatcgtacatgtggccgcgcgccgaggaggagccggtcgaatacgaaagatggtggcacccttgctggagcggcaatag

SEQ ID NO: 114 - DNA, 936 bp, burkholderia rhizoxinica
atgccggtgacgtctgtgtatcagaaagataaaccgtttggtgcccggcttaatctcagcccgttcgaatgtttaaagattgagaaacattctggtggtgctgacgccctggagtttatctcaaataaatacgatgcgcttactcaggtactgagtcgggctgacatcctgaaaatcgcctgccatgactgcgcagcccatgcgctgcaggcggtgctcgactatgaacaggtattccgtcagcgtggttttgctcgggccgatattataaaaattacagggaatggcggtggggcccaggcgctgaaggcagtcgtcgtacacgggccgacgcttaacgagtgcggcttcagtcaagctgacatcgtgagaatcgcggacaatatcggcggggcacaggcgctgaaggcggtgcttgagcacgggccgacgcttaacgagcgcgactacagtggggctgacatcgtgaagattgccggcaacggcggcggtgctcgagcgctcaaggcggttgttatgcacgggccaacgctttgcgagagtggctacagtggagccgacatcgtgaagattgccagcaatggcggtggtgctcaggcgctggaggcggttgccatgcacgggtcaacgctttgcgagcgtggctactgccggaccgatattgcaaagattgccggtaatggcggcggtgcccaggcgctcaaggcgattgtcatgcacgggccaacgctttgcgagcgtggctacagccggaccgatattgtaaagattgccgataacaatggcggtgcccaggcgctcaaagcggtgttcgaacatggaccagcgctcacgcaagcaggacgttcgaacgaggatattgtgaatatggctgcgcgcacaggcgcggccggccagatacgaaagatggctgcacaattgtcggggcggcaatag

SEQ ID NO: 115 - DNA, 192 bp, burkholderia rhizoxinica
ttgcaagctgtgctcgactgtgggccgatgctaagcaagcgcggtttcagccaagccgacatcgtgaaaatcgcgtgcaacggtggagcgcaggcgctgtattcagtgcttgacgttgagccgacgcttcgcgagcgcggtttcagccgagtcgatatcgttaaaattgcgggcaataacggtggggcatag

SEQ ID NO: 116 - DNA, 675 bp, Unknown
  marine organisms metagenomic database
attattaatttatattttgcaaggagttttgtatttatgagtaatcaaacagagcaaaaaattctaaagtttaagctagagctgcgctatccaacagaatcagctcaattaatacgtgctggatttaatcgagatcaagcggataggattatcttaagaggctcttcacaacgtaccgttgcaaagttactggaaattcacaagacgttgttagctcatccctatagaataacctacgacgacctcactcgaattgcagcaagaaatggaggctctaaaaacttagtggcggtgcaagcaaactatgctgccttaacagaactcgggtttagtgctaaggatattgtgcagatggtgtcacatggtggaggctctaaaaacttagaggtggtacaagcaaactatgctgccttaacaggactcgggtttcgtactgaggatattgtgcagatggtgtcacatgatggaggctctaaaaacttagcggctatgatagacaagtctactgccttaaaagaccttgggtttcgtactgaggatattgtgcagatggtgtcacatgatggaagctctaaaaacttagcggctatgatagacaagtctactgccttaaaaggcctcggatttcgtactgagggtattgtgcagatggtgtcacatgggtggaggctctaa

SEQ ID NO: 117 - DNA, 988 bp, Unknown
  marine organisms metagenomic database
ctgagggtattgtgcagatggtgtcacatgggtggaggctctaaaaacttagtggcggtgcaagcaaactatgctgccttaacaggactcggatttcgtactgagggtattgtgcagatggtgtcacatggtggaggctctaaaaacttagtggcggtgcaagcaaactatgctgccttaacaggactcgggtttcgtactgaggatattgtgcagatggtgtcacatgatggaggctctaaaaacttagtggcggtgcaagcaaactatgctgccttaacaggactcgggtttcgtactgaggatattgtgcagatggtgtcacatgatggaggctctaaaaacttagcggctattatagacaagtctactgccttaacaggccttgggtttcgtactgaggatattgtgcagatggtgtctaacaatggaggctctaaaaacttagcggctattatagacaagtctactgccttaaaaggcctcggatttcgtactgaggatattgtgcagatggtgtcacatggtggaggctctaaaaacttagaggtggtgcaagcaaactatgctgccttaacaggactcggatttcgtactgagggtattgtgcagatggtgtcacatggtggaggctctaaaaacttagtggcggtgcaagcaaactatgctgccttaacaggactcgggtttcgtactgaggatattgtgcagatggtgtcacatgatggaggctctaaaaacttagcggctatgatagacaagtatactgccttaaaagaccttgggtttcgtactgaggatattgtgcagatggtgtcacatgatggaggctctaaaaacttagcggctattatagacaagtctactgccttaaaaggcctcggatttcttactgaggatattgtgcagatggtgtcacatgatggaggctctaaaaacttagaggtggtgcaagcaagctatgataccttaacagaactcaagttta

SEQ ID NO: 118 - DNA, 891 bp, Unknown
  marine organisms metagenomic database
gtgggtgacttaagagctaaggaactggaacccaaagatattgtgtccattgcgtctaatactggcgcaaataagactattaccaggttactagaaaagtggggtgacttaagagctaaggaactggaacccaaagatattgtatccattgcgtcacatgatgggtcaaatcagactattacaaagttactagaaaaatgggatgagttaagagctaagggactggagcccaaagatattgtatccattgcgtctcatattggcgcaaatcagactattactacgttactaaacaagtggggtgcgttaatagatttggaactggaacccaaagatattgtatccattgcgtctcatattggcgcaactcaggctattactacgttactaaacaagtgggctgccttaagagctaagggactggaccccaaagatattgtatctattgcgtcacatgatgggtcaaatcagacgattacaaagttactagaaaaatgggatgagttaagagctaaggaactggaatccaaagatattgtatccattgcgtctaataatggcgcaactcagactattaccaggttactagaaaaatgggatgagttaagagctaagggactggaccccaaagatattgtatccattgcgtctcatggtggtgcaactcaggctattaccacgttactaaacaggtggggtgacttaatagatttggaactggaacccaaagatattgtatccattgcgtctcataaaggagcaaatcaggttattactacgttactagaaaagtgggatgacttaattagtcaggcatatactaagtctagcattgtgagtattgcttctactcagaatggcgtattaggcctattggaggcgttaggttaa

SEQ ID NO: 119 - DNA, 740 bp, Unknown
  marine organisms metagenomic database
ttggataagaacgccattttaaagatttcaatttgtaacggggctcatttggcgattaccacgttactagaaaactgggatgcgttaatagatttggaactggaacccaaagatattgtatctattgcgtctcatggtggggcaactcaggcgattaccacgttactaaacaagtgggatgacttaagagataagggactggaacccaaagatattgtatccattgcgtctaataatggcgcaactcaggctattgctacgttattagcaaaatgggattccttaatagctaagggactgcagcccaaagatattgtatccattgcgtctcatggtggggcaactcaggctattaccacgttactaaacaggtggggtgacttaagagctaaggaactggaacccaaagatattgtatccattgcgtctcatgatggggcaactcaggctattaccacgttactagaaaaatgggatgagttaagagctaagggactggaacccaaagatattgtatccattgcgtctcatattggcgcaaatcagactattactacgttactaaacaagtggggtgcgttaatagatttggaactggaacccaaagatattgtatccattgcgtctcatggtggggcaaataaggctattaccacgttactagaaaagtgggctgccttaagagctaaggaactggaacccaaagatattgtatccattgcgtctcataatggagcaac

SEQ ID NO: 120 - DNA, 433 bp, Unknown
  marine organisms metagenomic database
ttggagcaataaggctattaccacgttactagaaaactgggagaaattaataaaaaagggacttaaaccagaagatattgtaactattgcgtctcatcatggtggaagtcaggctattaccacgttattagaaaactgggatgacttactaaaattggaacttaaattcgaagatattgtatccattgcgtctcataatggcgcaagtcaagctattaccacgttactagaaaactgggagaaattaataaaaaagggacttaaacccgaagatattgtatccattgcgtctcatagtggcggaagtcaggctattaccacgttactagaaaactgggatgacttaattgatcaggaatatactgagtctgaaattgtgaatattttttctagccaggatggcgttttgaaactattggcggagttagattaa

SEQ ID NO: 121 - DNA, 498 bp, Artificial sequence
  Description of artificial sequence: synthetic polynucleotide
ggcgcgcctacacagcggccttgccaccatgggcgatcctaaaaagaaacgtaaggtcatcgattacccatacgatgttccagattacgctatcgatatcgcctcaaccgccttcgtggaccaggataagcaaatggccaaccgcttgaacctgagtcccctggagaggtctaagattgagaagcagtacggcggggccacaactctggcctttatctccaacaagcagaacgagctggcccagatccttagccgggcagacatcttgaagattgcctcctatgattgtgctgcacacgccctccaggctgtcctcgattgcgggccaatgctggggaagagaggattctccggagacgcccgggggatcaggtcacgtgcgtctcggagaagcaatgaggaaatcgtccatgtggccgctagaaggggcggagccggcaggattcggaaaatggtggcccctctcctggagcggcagggcagatctggctcggatcc

SEQ ID NO: 122 - DNA, 1998 bp, artificial sequence
  Description of artificial sequence: synthetic polynucleotide
accgcgtctctctcccagagtgatattgtaaaaatcgctggcaacattggaggagcccaggctcttcaggctgtgctggacctggaatccatgcttggcaagcggggcttcagccgcgacgacatcgccaaaatggccggcaacattggcggagcccagactcttcaggccgtgctggacttggagtccgccttcagggagcgggggttctcccaggctgatattgtcaagatcgccggaaacaatggcggggcccaggccctgtattccgtgctggacgtggaaccaacactggggaaacgggggttctctcgggccgacattgtgaagatcgctgggaacacagggggcgcccaagccctccacactgtgttggatctggagccagccctcgggaagagaggcttcagccggattgacattgtgaaaattgccgccaacaacgggggagcccaggcccttcatgctgtgctcgatctgggacccacactgagggagtgcggcttcagccaggccacaatcgccaagatcgcaggcaacatcggaggcgctcaagccctccagatggtcctcgacctgggacctgccttgggcaagagggggttcagccaggctacaatcgctaagatcgcaggaaacatcgggggcgctcaggcactccagacagtgctggatttggagcctgccctgtgtgagagggggttttcccaggccaccatcgccaagatggccgggaataacggcggcgcccaagcattgcagaccgtgctcgacctggagcccgccctgaggaagagggattttcgccaggccgatattatcaagatcgctggaaatgatggcggcgctcaggccctccaggctgtgatcgagcacgggccaaccctgaggcagcacgggttcaacctggctgacattgtcaagatggctgggaacatcggcggggctcaggccctgcaagccgtgctggatctgaagcccgtcttggacgaacatgggtttagccagcctgatattgtgaagatggccggaaacatcggcggagcacaggcccttcaagccgtgctcagcttggggcccgcactgagggagagagggttctcacagcccgacatcgtgaagattgccggaaacactgggggggcccaagccttgcaggcagtcctggacctggagctgactctggtggagcacggcttctcccagccagacattgtgcggatcacaggcaaccgggggggagcacaggctctccaggccgtcctggcccttgagctgaccctgagagagcgggggtttagccaacccgatattgtaaagattgccggcaactccgggggcgcacaggccctccaagccgtcctggatctggagttgacctttagggagcggggatttagccaggccgacatcgtcaaaattgccgggaacgatgggggcacccaggccctgcacgccgtcctcgatctggagagaatgctgggcgagagagggttttcacgggctgacatcgtgaacgtggccgggaacaacggcggggcccaagcactcaaggccgtgctcgaacacgaagccactctgaacgagaggggcttttctagggccgatattgtgaaaatcgccggcaacggcggaggcgcccaggccctcaaagccgtccttgaacacgaggccacactcgatgagcggggctttagccgggcagacatcgtgaggatcgccgggaacgggggaggggcccaggctctgaaggctgtcctggagcacgggcctaccctgaacgagcgcggcttcaacctcacagatattgtggagatggccgccaacagcggaggggcccaagctctcaaggccgtcttggagcatggccccaccctgagacagagagggctcagtttgattgatattgtcgaaatcgcctccaacggaggggcacaagcccttaaggccgtgttgaagtacggccccgtcctgatgcaggccgggagaggagacgcc

SEQ ID NO: 123 - DNA, 616 bp, artificial sequence
  Description of artificial sequence: synthetic polynucleotide
ggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgac

SEQ ID NO: 124 - DNA, 1086 bp, artificial sequence
  Description of artificial sequence: synthetic polynucleotide
atgggcgatcctaaaaagaaacgtaaggtcatcgattacccatacgatgttccagattacgctatcgatatcgcctcaaccgccttcgtggaccaggataagcaaatggccaaccgcttgaacctgagtcccctggagaggtctaagattgagaagcagtacggcggggccacaactctggcctttatctccaacaagcagaacgagctggcccagatccttagccgggcagacatcttgaagattgcctcctatgattgtgctgcacacgccctccaggctgtcctcgattgcgggccaatgctggggaagagaggattctccggagacgcccgggggatcaggtcacgtgcgtctcggagaagcaatgaggaaatcgtccatgtggccgctagaaggggcggagccggcaggattcggaaaatggtggcccctctcctggagcggcagggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 125 - DNA, 3021 bp, artificial sequence
  Description of artificial sequence: synthetic polynucleotide
atgggcgatcctaaaaagaaacgtaaggtcatcgattacccatacgatgttccagattacgctatcgatatcgcctcaaccgccttcgtggaccaggataagcaaatggccaaccgcttgaacctgagtcccctggagaggtctaagattgagaagcagtacggcggggccacaactctggcctttatctccaacaagcagaacgagctggcccagatccttagccgggcagacatcttgaagattgcctcctatgattgtgctgcacacgccctccaggctgtcctcgattgcgggccaatgctggggaagagaggattctcccagagtgatattgtaaaaatcgctggcaacattggaggagcccaggctcttcaggctgtgctggacctggaatccatgcttggcaagcggggcttcagccgcgacgacatcgccaaaatggccggcaacattggcggagcccagactcttcaggccgtgctggacttggagtccgccttcagggagcgggggttctcccaggctgatattgtcaagatcgccggaaacaatggcggggcccaggccctgtattccgtgctggacgtggaaccaacactggggaaacgggggttctctcgggccgacattgtgaagatcgctgggaacacagggggcgcccaagccctccacactgtgttggatctggagccagccctcgggaagagaggcttcagccggattgacattgtgaaaattgccgccaacaacgggggagcccaggcccttcatgctgtgctcgatctgggacccacactgagggagtgcggcttcagccaggccacaatcgccaagatcgcaggcaacatcggaggcgctcaagccctccagatggtcctcgacctgggacctgccttgggcaagagggggttcagccaggctacaatcgctaagatcgcaggaaacatcgggggcgctcaggcactccagacagtgctggatttggagcctgccctgtgtgagagggggttttcccaggccaccatcgccaagatggccgggaataacggcggcgcccaagcattgcagaccgtgctcgacctggagcccgccctgaggaagagggattttcgccaggccgatattatcaagatcgctggaaatgatggcggcgctcaggccctccaggctgtgatcgagcacgggccaaccctgaggcagcacgggttcaacctggctgacattgtcaagatggctgggaacatcggcggggctcaggccctgcaagccgtgctggatctgaagcccgtcttggacgaacatgggtttagccagcctgatattgtgaagatggccggaaacatcggcggagcacaggcccttcaagccgtgctcagcttggggcccgcactgagggagagagggttctcacagcccgacatcgtgaagattgccggaaacactgggggggcccaagccttgcaggcagtcctggacctggagctgactctggtggagcacggcttctcccagccagacattgtgcggatcacaggcaaccgggggggagcacaggctctccaggccgtcctggcccttgagctgaccctgagagagcgggggtttagccaacccgatattgtaaagattgccggcaactccgggggcgcacaggccctccaagccgtcctggatctggagttgacctttagggagcggggatttagccaggccgacatcgtcaaaattgccgggaacgatgggggcacccaggccctgcacgccgtcctcgatctggagagaatgctgggcgagagagggttttcacgggctgacatcgtgaacgtggccgggaacaacggcggggcccaagcactcaaggccgtgctcgaacacgaagccactctgaacgagaggggcttttctagggccgatattgtgaaaatcgccggcaacggcggaggcgcccaggccctcaaagccgtccttgaacacgaggccacactcgatgagcggggctttagccgggcagacatcgtgaggatcgccgggaacgggggaggggcccaggctctgaaggctgtcctggagcacgggcctaccctgaacgagcgcggcttcaacctcacagatattgtggagatggccgccaacagcggaggggcccaagctctcaaggccgtcttggagcatggccccaccctgagacagagagggctcagtttgattgatattgtcgaaatcgcctccaacggaggggcacaagcccttaaggccgtgttgaagtacggccccgtcctgatgcaggccgggagaagcaatgaggaaatcgtccatgtggccgctagaaggggcggagccggcaggattcggaaaatggtggcccctctcctggagcggcagggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 126 - DNA, 57 bp, artificial sequence
  Description of artificial sequence: synthetic polynucleotide
taagagaagcaaagacgttactagcatgaaggtaccgtaacgtctttgcttctctta

SEQ ID NO: 127 - DNA, 57 bp, artificial sequence
  Description of artificial sequence: synthetic polynucleotide
aaagagaagcaaagacgttactagcatgaaggtaccgtaacgtctttgcttctcttt

SEQ ID NO: 128 - DNA, 57 bp, artificial sequence
  Description of artificial sequence: synthetic polynucleotide
caagagaagcaaagacgttactagcatgaaggtaccgtaacgtctttgcttctcttg

SEQ ID NO: 129 - DNA, 57 bp, artificial sequence
  Description of artificial sequence: synthetic polynucleotide
gaagagaagcaaagacgttactagcatgaaggtaccgtaacgtctttgcttctcttc

SEQ ID NO: 130 - DNA, 57 bp, artificial sequence
  Description of artificial sequence: synthetic polynucleotide
taagcgaagcaactacgttactagcatgaaggtaccgtaacgtagttgcttcgctta

SEQ ID NO: 131 - DNA, 57 bp, artificial sequence
  Description of artificial sequence: synthetic polynucleotide
aaagcgaagcaactacgttactagcatgaaggtaccgtaacgtagttgcttcgcttt

SEQ ID NO: 132 - DNA, 57 bp, artificial sequence
  Description of artificial sequence: synthetic polynucleotide
caagcgaagcaactacgttactagcatgaaggtaccgtaacgtagttgcttcgcttg

SEQ ID NO: 133 - DNA, 57 bp, artificial sequence
  Description of artificial sequence: synthetic polynucleotide
gaagcgaagcaactacgttactagcatgaaggtaccgtaacgtagttgcttcgcttc

SEQ ID NO: 134 - DNA, 57 bp, artificial sequence
  Description of artificial sequence: synthetic polynucleotide
taagagaagcaaatacgttactagcatgaaggtaccgtaacgtatttgcttctctta

SEQ ID NO: 135 - DNA, 57 bp, artificial sequence
  Description of artificial sequence: synthetic polynucleotide
aaagagaagcaaatacgttactagcatgaaggtaccgtaacgtatttgcttctcttt

SEQ ID NO: 136 - DNA, 57 bp, artificial sequence
  Description of artificial sequence: synthetic polynucleotide
caagagaagcaaatacgttactagcatgaaggtaccgtaacgtatttgcttctcttg

SEQ ID NO: 137 - DNA, 57 bp, artificial sequence
  Description of artificial sequence: synthetic polynucleotide
gaagagaagcaaatacgttactagcatgaaggtaccgtaacgtatttgcttctcttc

SEQ ID NO: 138 - DNA, 57 bp, artificial sequence
  Description of artificial sequence: synthetic polynucleotide
tttatataaacctaaccctcttagcatgaaggtaccagagggttaggtttatataca

SEQ ID NO: 139 - DNA, 61 bp, artificial sequence
  Description of artificial sequence: synthetic polynucleotide
attaagagaagcaaagacgttactagcatgaaggtaccgtaacgtctttgcttctcttaat

SEQ ID NO: 140 - DNA, 61 bp, artificial sequence
  Description of artificial sequence: synthetic polynucleotide
gttaagagaagcaaagacgttactagcatgaaggtaccgtaacgtctttgcttctcttaac

SEQ ID NO: 141 - DNA, 61 bp, artificial sequence
  Description of artificial sequence: synthetic polynucleotide
cttaagagaagcaaagacgttactagcatgaaggtaccgtaacgtctttgcttctcttaag

SEQ ID NO: 142 - DNA, 61 bp, artificial sequence
  Description of artificial sequence: synthetic polynucleotide
tataagagaagcaaagacgttactagcatgaaggtaccgtaacgtctttgcttctcttata

SEQ ID NO: 143 - DNA, 61 bp, artificial sequence
  Description of artificial sequence: synthetic polynucleotide
tctaagagaagcaaagacgttactagcatgaaggtaccgtaacgtctttgcttctcttaga

SEQ ID NO: 144 - DNA, 61 bp, artificial sequence
  Description of artificial sequence: synthetic polynucleotide
tgtaagagaagcaaagacgttactagcatgaaggtaccgtaacgtctttgcttctcttaca

SEQ ID NO: 145 - DNA, 61 bp, artificial sequence
  Description of artificial sequence: synthetic polynucleotide
ataaagagaagcaaagacgttactagcatgaaggtaccgtaacgtctttgcttctctttat

SEQ ID NO: 146 - DNA, 61 bp, artificial sequence
  Description of artificial sequence: synthetic polynucleotide
gtaaagagaagcaaagacgttactagcatgaaggtaccgtaacgtctttgcttctctttac

SEQ ID NO: 147 - DNA, 61 bp, artificial sequence
  Description of artificial sequence: synthetic polynucleotide
ctaaagagaagcaaagacgttactagcatgaaggtaccgtaacgtctttgcttctctttag

SEQ ID NO: 148 - DNA, 61 bp, artificial sequence
  Description of artificial sequence: synthetic polynucleotide
taaaagagaagcaaagacgttactagcatgaaggtaccgtaacgtctttgcttctctttta

SEQ ID NO: 149 - DNA, 61 bp, artificial sequence
  Description of artificial sequence: synthetic polynucleotide
tcaaagagaagcaaagacgttactagcatgaaggtaccgtaacgtctttgcttctctttga

SEQ ID NO: 150 - DNA, 61 bp, artificial sequence
  Description of artificial sequence: synthetic polynucleotide
tgaaagagaagcaaagacgttactagcatgaaggtaccgtaacgtctttgcttctctttca

SEQ ID NO: 151 - DNA, 61 bp, artificial sequence
  Description of artificial sequence: synthetic polynucleotide
atcaagagaagcaaagacgttactagcatgaaggtaccgtaacgtctttgcttctcttgat

SEQ ID NO: 152 - DNA, 61 bp, artificial sequence
  Description of artificial sequence: synthetic polynucleotide
gtcaagagaagcaaagacgttactagcatgaaggtaccgtaacgtctttgcttctcttgac

SEQ ID NO: 153 - DNA, 61 bp, artificial sequence
  Description of artificial sequence: synthetic polynucleotide
ctcaagagaagcaaagacgttactagcatgaaggtaccgtaacgtctttgcttctcttgag

SEQ ID NO: 154 - DNA, 61 bp, artificial sequence
  Description of artificial sequence: synthetic polynucleotide
tacaagagaagcaaagacgttactagcatgaaggtaccgtaacgtctttgcttctcttgta

SEQ ID NO: 155 - DNA, 61 bp, artificial sequence
  Description of artificial sequence: synthetic polynucleotide
tccaagagaagcaaagacgttactagcatgaaggtaccgtaacgtctttgcttctcttgga

SEQ ID NO: 156 - DNA, 61 bp, artificial sequence
  Description of artificial sequence: synthetic polynucleotide
tgcaagagaagcaaagacgttactagcatgaaggtaccgtaacgtctttgcttctcttgca

SEQ ID NO: 157 - DNA, 61 bp, artificial sequence
  Description of artificial sequence: synthetic polynucleotide
ctgaagagaagcaaagacgttactagcatgaaggtaccgtaacgtctttgcttctcttcag

SEQ ID NO: 158 - DNA, 61 bp, artificial sequence
  Description of artificial sequence: synthetic polynucleotide
tagaagagaagcaaagacgttactagcatgaaggtaccgtaacgtctttgcttctcttcta

SEQ ID NO: 159 - DNA, 61 bp, artificial sequence
  Description of artificial sequence: synthetic polynucleotide
tcgaagagaagcaaagacgttactagcatgaaggtaccgtaacgtctttgcttctcttcga

SEQ ID NO: 160 - DNA, 1803 bp, artificial sequence
  Description of artificial sequence: synthetic polynucleotide
accgcgtctctctcccagtcagatatagtcaagatagcaggacatgatggtggcgctcaggcgttgcaagcggttctcgacctggagagcatgctgggcaagaggggcttttcacgcgacgacattgctaagatggctgggaacggcggcggggcccagacacttcaggcagtactggacctggagtcagcttttcgagagcgcggcttctcccaggcagacatagtgaaaatcgcaggcaacatcggaggcgcacaagccctgtacagtgtgctggacgtggagccaactctggggaagcgggggttttctagagcagatattgtcaagattgcagggaacggtggcggtgcgcaagccctgcacactgtgctggatcttgaacctgcgcttggtaagagaggattctctcgcatcgacatcgtaaagattgcggccaacattggcggggctcaggctctccacgccgtactggacttgggccccacgctccgagagtgtgggttcagccaggccaccatcgctaagatcgccggaaacatcggcggggcacaggcactccagatggtgcttgatctgggcccggccctgggcaaacgcgggttctcccaagctacgattgccaagatcgcaggaaatatcggcggagcgcaggctcttcagaccgtgctggaccttgagcctgccttgtgcgagcgcgggtttagtcaggccacaattgccaaaatggctggccacgatggaggtgcccaagctctccagactgtgcttgacctggaacccgccctccgaaaaagggattttcggcaggccgacatcatcaaaattgccggccacgacggtggagcgcaagccttgcaagcagttatcgaacacgggccaaccctgcggcagcatggctttaacctcgccgacatcgtgaagatggccggaaatggaggtggcgcacaggccctccaggccgtcttggatctgaagccagttcttgatgagcacggatttagccagcctgacattgtgaaaatggccgggaatatcggtggagcacaagcactccaggctgtcctgagtctgggtccagctctgcgggaacggggcttctctcaacctgacatagtcaaaatcgctggtaatattggcggtgctcaggcattgcaggccgttctcgatctggagctgaccctcgtggaacacgggttttcccaggccgatattgtgaagatagccggacacgatggggggacacaggcgctgcatgccgtcctggatctggagaggatgctgggcgagagagggttctccagagctgacatcgtcaacgtcgccgggcatgatgggggagcacaggctttgaaggctgtactggaacatgaggctaccctgaatgagaggggattcagccgggctgatattgttaagatcgctggacatgacggaggcgctcaagctctcaaagccgtgctcgaacacgaggcaactctggatgagcggggcttcagcagggcagacatcgttaatgttgccggaaacggtgggggtgcccaggccctcaaagcagtcctggaacacgaagccacactcaacgagcgaggattcaatttgaccgacattgtggaaatggcagcccacgatggcggcgcccaggcgttgaaagccgtgttggaacatggccccacactcaggcagagagggctgtctcttatcgacatagtggaaattgcaggcaatggcgggggagcccaggctctgaaagcggtgctgaagtatggacccgtgcttatgcaggccgggagaggagacgcc

SEQ ID NO: 161 - DNA, 2826 bp, artificial sequence
  Description of artificial sequence: synthetic polynucleotide
atgggcgatcctaaaaagaaacgtaaggtcatcgattacccatacgatgttccagattacgctatcgatatcgcctcaaccgccttcgtggaccaggataagcaaatggccaaccgcttgaacctgagtcccctggagaggtctaagattgagaagcagtacggcggggccacaactctggcctttatctccaacaagcagaacgagctggcccagatccttagccgggcagacatcttgaagattgcctcctatgattgtgctgcacacgccctccaggctgtcctcgattgcgggccaatgctggggaagagaggattctcccagtcagatatagtcaagatagcaggacatgatggtggcgctcaggcgttgcaagcggttctcgacctggagagcatgctgggcaagaggggcttttcacgcgacgacattgctaagatggctgggaacggcggcggggcccagacacttcaggcagtactggacctggagtcagcttttcgagagcgcggcttctcccaggcagacatagtgaaaatcgcaggcaacatcggaggcgcacaagccctgtacagtgtgctggacgtggagccaactctggggaagcgggggttttctagagcagatattgtcaagattgcagggaacggtggcggtgcgcaagccctgcacactgtgctggatcttgaacctgcgcttggtaagagaggattctctcgcatcgacatcgtaaagattgcggccaacattggcggggctcaggctctccacgccgtactggacttgggccccacgctccgagagtgtgggttcagccaggccaccatcgctaagatcgccggaaacatcggcggggcacaggcactccagatggtgcttgatctgggcccggccctgggcaaacgcgggttctcccaagctacgattgccaagatcgcaggaaatatcggcggagcgcaggctcttcagaccgtgctggaccttgagcctgccttgtgcgagcgcgggtttagtcaggccacaattgccaaaatggctggccacgatggaggtgcccaagctctccagactgtgcttgacctggaacccgccctccgaaaaagggattttcggcaggccgacatcatcaaaattgccggccacgacggtggagcgcaagccttgcaagcagttatcgaacacgggccaaccctgcggcagcatggctttaacctcgccgacatcgtgaagatggccggaaatggaggtggcgcacaggccctccaggccgtcttggatctgaagccagttcttgatgagcacggatttagccagcctgacattgtgaaaatggccgggaatatcggtggagcacaagcactccaggctgtcctgagtctgggtccagctctgcgggaacggggcttctctcaacctgacatagtcaaaatcgctggtaatattggcggtgctcaggcattgcaggccgttctcgatctggagctgaccctcgtggaacacgggttttcccaggccgatattgtgaagatagccggacacgatggggggacacaggcgctgcatgccgtcctggatctggagaggatgctgggcgagagagggttctccagagctgacatcgtcaacgtcgccgggcatgatgggggagcacaggctttgaaggctgtactggaacatgaggctaccctgaatgagaggggattcagccgggctgatattgttaagatcgctggacatgacggaggcgctcaagctctcaaagccgtgctcgaacacgaggcaactctggatgagcggggcttcagcagggcagacatcgttaatgttgccggaaacggtgggggtgcccaggccctcaaagcagtcctggaacacgaagccacactcaacgagcgaggattcaatttgaccgacattgtggaaatggcagcccacgatggcggcgcccaggcgttgaaagccgtgttggaacatggccccacactcaggcagagagggctgtctcttatcgacatagtggaaattgcaggcaatggcgggggagcccaggctctgaaagcggtgctgaagtatggacccgtgcttatgcaggccgggagaagcaatgaggaaatcgtccatgtggccgctagaaggggcggagccggcaggattcggaaaatggtggcccctctcctggagcggcagggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 162 - protein, 33 aa, artificial sequence
  Description of artificial sequence: synthetic polypeptide
  misc_feature (12)..(13): Xaa can be any naturally occurring amino acid
FSQSDIVKIAGXXGGAQALQAVLDLESMLGKRG

SEQ ID NO: 163 - protein, 33 aa, artificial sequence
  Description of artificial sequence: synthetic polypeptide
  misc_feature (12)..(13): Xaa can be any naturally occurring amino acid
FSRDDIAKMAGXXGGAQTLQAVLDLESAFRERG

SEQ ID NO: 164 - protein, 33 aa, artificial sequence
  Description of artificial sequence: synthetic polypeptide
  misc_feature (12)..(13): Xaa can be any naturally occurring amino acid
FSQADIVKIAGXXGGAQALYSVLDVEPTLGKRG

SEQ ID NO: 165 - protein, 33 aa, artificial sequence
  Module BurrH_36 4
  misc_feature (12)..(13): Xaa can be any amino acid
FSRADIVKIAGXXGGAQALHTVLDLEPALGKRG

SEQ ID NO: 166 - protein, 33 aa, artificial sequence
  Description of artificial sequence: synthetic polypeptide
  misc_feature (12)..(13): Xaa can be any naturally occurring amino acid
FSRIDIVKIAAXXGGAQALHAVLDLGPTLRECG

SEQ ID NO: 167 - protein, 33 aa, artificial sequence
  Description of artificial sequence: synthetic polypeptide
  misc_feature (12)..(13): Xaa can be any naturally occurring amino acid
FSQATIAKIAGXXGGAQALQMVLDLGPALGKRG

SEQ ID NO: 168 - protein, 33 aa, artificial sequence
  Description of artificial sequence: synthetic polypeptide
  misc_feature (12)..(13): Xaa can be any naturally occurring amino acid
FSQATIAKIAGXXGGAQALQTVLDLEPALCERG

SEQ ID NO: 169 - protein, 33 aa, artificial sequence
  Description of artificial sequence: synthetic polypeptide
  misc_feature (12)..(13): Xaa can be any naturally occurring amino acid
FSQATIAKMAGXXGGAQALQTVLDLEPALRKRD

SEQ ID NO: 170 - protein, 33 aa, artificial sequence
  Module BurrH_36 9
  misc_feature (12)..(13): Xaa can be any amino acid
FRQADIIKIAGXXGGAQALQAVIEHGPTLRQHG

SEQ ID NO: 171 - protein, 33 aa, artificial sequence
  Description of artificial sequence: synthetic polypeptide
  misc_feature (12)..(13): Xaa can be any naturally occurring amino acid
FNLADIVKMAGXXGGAQALQAVLDLKPVLDEHG

SEQ ID NO: 172 - protein, 33 aa, artificial sequence
  Description of artificial sequence: synthetic polypeptide
  misc_feature (12)..(13): Xaa can be any naturally occurring amino acid
FSQPDIVKMAGXXGGAQALQAVLSLGPALRERG

SEQ ID NO: 173 - protein, 33 aa, artificial sequence
  Description of artificial sequence: synthetic polypeptide
  misc_feature (12)..(13): Xaa can be any naturally occurring amino acid
FSQPDIVKIAGXXGGAQALQAVLDLELTLVEHG

SEQ ID NO: 174 - protein, 33 aa, artificial sequence
  Description of artificial sequence: synthetic polypeptide
  misc_feature (12)..(13): Xaa can be any naturally occurring amino acid
FSQPDIVRITGXXGGAQALQAVLALELTLRERG

SEQ ID NO: 175 - protein, 33 aa, artificial sequence
  Description of artificial sequence: synthetic polypeptide
  misc_feature (12)..(13): Xaa can be any naturally occurring amino acid
FSQPDIVKIAGXXGGAQALQAVLDLELTFRERG

SEQ ID NO: 176 - protein, 33 aa, artificial sequence
  Description of artificial sequence: synthetic polypeptide
  misc_feature (12)..(13): Xaa can be any naturally occurring amino acid
FSQADIVKIAGXXGGTQALHAVLDLERMLGERG

SEQ ID NO: 177 - protein, 33 aa, artificial sequence
  Description of artificial sequence: synthetic polypeptide
  misc_feature (12)..(13): Xaa can be any naturally occurring amino acid
FSRADIVNVAGXXGGAQALKAVLEHEATLNERG

SEQ ID NO: 178 - protein, 33 aa, artificial sequence
  Description of artificial sequence: synthetic polypeptide
  misc_feature (12)..(13): Xaa can be any naturally occurring amino acid
FSRADIVKIAGXXGGAQALKAVLEHEATLDERG

SEQ ID NO: 179 - protein, 33 aa, artificial sequence
  Description of artificial sequence: synthetic polypeptide
  misc_feature (12)..(13): Xaa can be any naturally occurring amino acid
FSRADIVRIAGXXGGAQALKAVLEHGPTLNERG

SEQ ID NO: 180 - protein, 33 aa, artificial sequence
  Description of artificial sequence: synthetic polypeptide
  misc_feature (12)..(13): Xaa can be any naturally occurring amino acid
FNLTDIVEMAAXXGGAQALKAVLEHGPTLRQRG

SEQ ID NO: 181 - protein, 33 aa, artificial sequence
  Description of artificial sequence: synthetic polynpeptide
  misc_feature (12)..(13): Xaa can be any naturally occurring amino acid
LSLIDIVEIAGXXGGAQALKAVLKYGPVLMQAG

SEQ ID NO: 182 - DNA, 43 bp, artificial sequence
  Description of artificial sequence: synthetic polynucleotide
tatataaacctaaccctctaggtaagagggttaggtttatata

SEQ ID NO: 183 - DNA, 44 bp, artificial sequence
  Description of artificial sequence: synthetic polynucleotide
tatataaacctaaccctctaaggtaagagggttaggtttatata

SEQ ID NO: 184 - DNA, 45 bp, artificial sequence
  Description of artificial sequence: synthetic polynucleotide
tatataaacctaaccctctaaggtacagagggttaggtttatata

SEQ ID NO: 185 - DNA, 46 bp, artificial sequence
  Description of artificial sequence: synthetic polynucleotide
tatataaacctaaccctctgaaggtacagagggttaggtttatata

SEQ ID NO: 186 - DNA, 47 bp, artificial sequence
  Description of artificial sequence: synthetic polynucleotide
tatataaacctaaccctctgaaggtaccagagggttaggtttatata

SEQ ID NO: 187 - DNA, 48 bp, artificial sequence
  Description of artificial sequence: synthetic polynucleotide
tatataaacctaaccctcttgaaggtaccagagggttaggtttatata

SEQ ID NO: 188 - DNA, 49 bp, artificial sequence
  Description of artificial sequence: synthetic polynucleotide
tatataaacctaaccctcttgaaggtacctagagggttaggtttatata

SEQ ID NO: 189 - DNA, 50 bp, artificial sequence
  Description of artificial sequence: synthetic polynucleotide
tatataaacctaaccctctatgaaggtacctagagggttaggtttatata

SEQ ID NO: 190 - DNA, 51 bp, artificial sequence
  Description of artificial sequence: synthetic polynucleotide
tatataaacctaaccctctatgaaggtaccttagagggttaggtttatata

SEQ ID NO: 191 - DNA, 52 bp, artificial sequence
  Description of artificial sequence: synthetic polynucleotide
tatataaacctaaccctctcatgaaggtaccttagagggttaggtttatata

SEQ ID NO: 192 - DNA, 53 bp, artificial sequence
  Description of artificial sequence: synthetic polynucleotide
tatataaacctaaccctcttagcatgaaggtaccagagggttaggtttatata

SEQ ID NO: 193 - DNA, 54 bp, artificial sequence
  Description of artificial sequence: synthetic polynucleotide
tatataaacctaaccctctgcatgaaggtaccttgagagggttaggtttatata

SEQ ID NO: 194 - DNA, 55 bp, artificial sequence
  Description of artificial sequence: synthetic polynucleotide
tatataaacctaaccctctgcatgaaggtaccttgtagagggttaggtttatata

SEQ ID NO: 195 - DNA, 56 bp, artificial sequence
  Description of artificial sequence: synthetic polynucleotide
tatataaacctaaccctctagcatgaaggtaccttgtagagggttaggtttatata

SEQ ID NO: 196 - DNA, 57 bp, artificial sequence
  Description of artificial sequence: synthetic polynucleotide
tatataaacctaaccctctagcatgaaggtaccttgtcagagggttaggtttatata

SEQ ID NO: 197 - DNA, 58 bp, artificial sequence
  Description of artificial sequence: synthetic polynucleotide
tatataaacctaaccctcttagcatgaaggtaccttgtcagagggttaggtttatata

SEQ ID NO: 198 - DNA, 59 bp, artificial sequence
  Description of artificial sequence: synthetic polynucleotide
tatataaacctaaccctcttagcatgaaggtaccttgtcgagagggttaggtttatata

SEQ ID NO: 199 - DNA, 60 bp, artificial sequence
  Description of artificial sequence: synthetic polynucleotide
tatataaacctaaccctcttagcatgaaggtaccttgtcgtagagggttaggtttatata

SEQ ID NO: 200 - DNA, 61 bp, artificial sequence
  Description of artificial sequence: synthetic polynucleotide
tatataaacctaaccctctctagcatgaaggtaccttgtcgtagagggttaggtttatata

SEQ ID NO: 201 - DNA, 62 bp, artificial sequence
  Description of artificial sequence: synthetic polynucleotide
tatataaacctaaccctctctagcatgaaggtaccttgtcgttagagggttaggtttatata

SEQ ID NO: 202 - DNA, 63 bp, artificial sequence
  Description of artificial sequence: synthetic polynucleotide
tatataaacctaaccctctactagcatgaaggtaccttgtcgttagagggttaggtttatata

SEQ ID NO: 203 - DNA, 64 bp, artificial sequence
  Description of artificial sequence: synthetic polynucleotide
tatataaacctaaccctctactagcatgaaggtaccttgtcgttgagagggttaggtttatata

SEQ ID NO: 204 - DNA, 65 bp, artificial sequence
  Description of artificial sequence: synthetic polynucleotide
tatataaacctaaccctctcactagcatgaaggtaccttgtcgttgagagggttaggtttatata

SEQ ID NO: 205 - DNA, 66 bp, artificial sequence
  Description of artificial sequence: synthetic polynucleotide
tatataaacctaaccctctcactagcatgaaggtaccttgtcgttgaagagggttaggtttatata

SEQ ID NO: 206 - DNA, 67 bp, artificial sequence
  Description of artificial sequence: synthetic polynucleotide
tatataaacctaaccctctccactagcatgaaggtaccttgtcgttgaagagggttaggtttatata

SEQ ID NO: 207 - DNA, 68 bp, artificial sequence
  Description of artificial sequence: synthetic polynucleotide
tatataaacctaaccctctccactagcatgaaggtaccttgtcgttgatagagggttaggtttatata

SEQ ID NO: 208 - DNA, 69 bp, artificial sequence
  Description of artificial sequence: synthetic polynucleotide
tatataaacctaaccctctaccactagcatgaaggtaccttgtcgttgatagagggttaggtttatata

SEQ ID NO: 209 - DNA, 70 bp, artificial sequence
  Description of artificial sequence: synthetic polynucleotide
tatataaacctaaccctctaccactagcatgaaggtaccttgtcgttgattagagggttaggtttatata

SEQ ID NO: 210 - DNA, 71 bp, artificial sequence
  Description of artificial sequence: synthetic polynucleotide
tatataaacctaaccctctgaccactagcatgaaggtaccttgtcgttgattagagggttaggtttatata

SEQ ID NO: 211 - DNA, 72 bp, artificial sequence
  Description of artificial sequence: synthetic polynucleotide
tatataaacctaaccctctgaccactagcatgaaggtaccttgtcgttgattcagagggttaggtttatata

SEQ ID NO: 212 - DNA, 73 bp, artificial sequence
  Description of artificial sequence: synthetic polynucleotide
tatataaacctaaccctcttgaccactagcatgaaggtaccttgtcgttgattcagagggttaggtttatata

SEQ ID NO: 213 - DNA, 74 bp, artificial sequence
  Description of artificial sequence: synthetic polynucleotide
tatataaacctaaccctcttgaccactagcatgaaggtaccttgtcgttgattcaagagggttaggtttatata

SEQ ID NO: 214 - DNA, 75 bp, artificial sequence
  Description of artificial sequence: synthetic polynucleotide
tatataaacctaaccctctctgaccactagcatgaaggtaccttgtcgttgattcaagagggttaggtttatata

SEQ ID NO: 215 - DNA, 76 bp, artificial sequence
  Description of artificial sequence: synthetic polynucleotide
tatataaacctaaccctctctgaccactagcatgaaggtaccttgtcgttgattcagagagggttaggtttatata

SEQ ID NO: 216 - DNA, 77 bp, artificial sequence
  Description of artificial sequence: synthetic polynucleotide
tatataaacctaaccctcttctgaccactagcatgaaggtaccttgtcgttgattcagagagggttaggtttatata

SEQ ID NO: 217 - DNA, 78 bp, artificial sequence
  Description of artificial sequence: synthetic polynucleotide
tatataaacctaaccctcttctgaccactagcatgaaggtaccttgtcgttgattcagtagagggttaggtttatata

SEQ ID NO: 218 - DNA, 1605 bp, artificial sequence
  Description of artificial sequence: synthetic polynucleotide
accgcgtctctctcccagtcagatatagtcaagatagcaggaaacaatggtggcgctcaggcgttgcaagcggttctcgacctggagagcatgctgggcaagaggggcttttcacgcgacgacattgctaagatggctgggaacggcggcggggcccagacacttcaggcagtactggacctggagtcagcttttcgagagcgcggcttctcccaggcagacatagtgaaaatcgcaggcaacggaggaggcgcacaagccctgtacagtgtgctggacgtggagccaactctggggaagcgggggttttctagagcagatattgtcaagattgcagggaacggtggcggtgcgcaagccctgcacactgtgctggatcttgaacctgcgcttggtaagagaggattctctcgcatcgacatcgtaaagattgcggccaacattggcggggctcaggctctccacgccgtactggacttgggccccacgctccgagagtgtgggttcagccaggccaccatcgctaagatcgccggtaacgggggcggggcacaggcactccagatggtgcttgatctgggcccggccctgggcaaacgcgggttctcccaagctacgattgccaagatcgcaggaaataacggcggagcgcaggctcttcagaccgtgctggaccttgagcctgccttgtgcgagcgcgggtttagtcaggccacaattgccaaaatggctggcaataacggaggtgcccaagctctccagactgtgcttgacctggaacccgccctccgaaaaagggattttcggcaggccgacatcatcaaaattgcgggcaacggcggtggagcgcaagccttgcaagcagttatcgaacacgggccaaccctgcggcagcatggctttaacctcgccgacatcgtgaagatggccggaaatggaggtggcgcacaggccctccaggccgtcttggatctgaagccagttcttgatgagcacggatttagccagcctgacattgtgaaaatggccgggaatatcggtggagcacaagcactccaggctgtcctgagtctgggtccagctctgcgggaacggggcttctctcaacctgacatagtcaaaatcgctggtcatgatggcggtgctcaggcattgcaggccgttctcgatctggagctgaccctcgtggaacacgggttttcccaggccgatattgtgaagatagccgggaatgggggggggacacaggcgctgcatgccgtcctggatctggagaggatgctgggcgagagagggttctccagagctgacatcgtcaacgtcgccgggaacggagggggagcacaggctttgaaggctgtactggaacatgaggctaccctgaatgagaggggattcaaccttactgatattgttgaaatggctgctaatatcggaggcgctcaagctctcaaagccgtgctcgaacatggacccactctgcggcaacggggcctcagcttgattgacatcgttgagattgccggaaacggtgggggtgcccaggccctcaaagcagtcctgaagtacgggccagttctcatgcaggccgggagaggagacgcc

SEQ ID NO: 219 - DNA, 1605 bp, artificial sequence
  Description of artificial sequence: synthetic polynucleotide
accgcgtctctctcccagtcagatatagtcaagatagcaggaaacatcggtggcgctcaggcgttgcaagcggttctcgacctggagagcatgctgggcaagaggggcttttcacgcgacgacattgctaagatggctgggaacggcggcggggcccagacacttcaggcagtactggacctggagtcagcttttcgagagcgcggcttctcccaggcagacatagtgaaaatcgcaggcaacattggaggcgcacaagccctgtacagtgtgctggacgtggagccaactctggggaagcgggggttttctagagcagatattgtcaagattgcagggaacggtggcggtgcgcaagccctgcacactgtgctggatcttgaacctgcgcttggtaagagaggattctctcgcatcgacatcgtaaagattgcggccaacggaggcggggctcaggctctccacgccgtactggacttgggccccacgctccgagagtgtgggttcagccaggccaccatcgctaagatcgccggtaacgggggcggggcacaggcactccagatggtgcttgatctgggcccggccctgggcaaacgcgggttctcccaagctacgattgccaagatcgcaggaaatatcggcggagcgcaggctcttcagaccgtgctggaccttgagcctgccttgtgcgagcgcgggtttagtcaggccacaattgccaaaatggctggcaatattggaggtgcccaagctctccagactgtgcttgacctggaacccgccctccgaaaaagggattttcggcaggccgacatcatcaaaattgcgggcaacaacggtggagcgcaagccttgcaagcagttatcgaacacgggccaaccctgcggcagcatggctttaacctcgccgacatcgtgaagatggccggacacgacggtggcgcacaggccctccaggccgtcttggatctgaagccagttcttgatgagcacggatttagccagcctgacattgtgaaaatggccgggaatatcggtggagcacaagcactccaggctgtcctgagtctgggtccagctctgcgggaacggggcttctctcaacctgacatagtcaaaatcgctggtcatgatggcggtgctcaggcattgcaggccgttctcgatctggagctgaccctcgtggaacacgggttttcccaggccgatattgtgaagatagccgggaatgggggggggacacaggcgctgcatgccgtcctggatctggagaggatgctgggcgagagagggttctccagagctgacatcgtcaacgtcgccgggaacggagggggagcacaggctttgaaggctgtactggaacatgaggctaccctgaatgagaggggattcaaccttactgatattgttgaaatggctgctaatatcggaggcgctcaagctctcaaagccgtgctcgaacatggacccactctgcggcaacggggcctcagcttgattgacatcgttgagattgccggaaacggtgggggtgcccaggccctcaaagcagtcctgaagtacgggccagttctcatgcaggccgggagaggagacgcc

SEQ ID NO: 220 - DNA, 2628 bp, artificial sequence
  Description of artificial sequence: synthetic polynucleotide
atgggcgatcctaaaaagaaacgtaaggtcatcgattacccatacgatgttccagattacgctatcgatatcgcctcaaccgccttcgtggaccaggataagcaaatggccaaccgcttgaacctgagtcccctggagaggtctaagattgagaagcagtacggcggggccacaactctggcctttatctccaacaagcagaacgagctggcccagatccttagccgggcagacatcttgaagattgcctcctatgattgtgctgcacacgccctccaggctgtcctcgattgcgggccaatgctggggaagagaggattctcccagtcagatatagtcaagatagcaggaaacaatggtggcgctcaggcgttgcaagcggttctcgacctggagagcatgctgggcaagaggggcttttcacgcgacgacattgctaagatggctgggaacggcggcggggcccagacacttcaggcagtactggacctggagtcagcttttcgagagcgcggcttctcccaggcagacatagtgaaaatcgcaggcaacggaggaggcgcacaagccctgtacagtgtgctggacgtggagccaactctggggaagcgggggttttctagagcagatattgtcaagattgcagggaacggtggcggtgcgcaagccctgcacactgtgctggatcttgaacctgcgcttggtaagagaggattctctcgcatcgacatcgtaaagattgcggccaacattggcggggctcaggctctccacgccgtactggacttgggccccacgctccgagagtgtgggttcagccaggccaccatcgctaagatcgccggtaacgggggcggggcacaggcactccagatggtgcttgatctgggcccggccctgggcaaacgcgggttctcccaagctacgattgccaagatcgcaggaaataacggcggagcgcaggctcttcagaccgtgctggaccttgagcctgccttgtgcgagcgcgggtttagtcaggccacaattgccaaaatggctggcaataacggaggtgcccaagctctccagactgtgcttgacctggaacccgccctccgaaaaagggattttcggcaggccgacatcatcaaaattgcgggcaacggcggtggagcgcaagccttgcaagcagttatcgaacacgggccaaccctgcggcagcatggctttaacctcgccgacatcgtgaagatggccggaaatggaggtggcgcacaggccctccaggccgtcttggatctgaagccagttcttgatgagcacggatttagccagcctgacattgtgaaaatggccgggaatatcggtggagcacaagcactccaggctgtcctgagtctgggtccagctctgcgggaacggggcttctctcaacctgacatagtcaaaatcgctggtcatgatggcggtgctcaggcattgcaggccgttctcgatctggagctgaccctcgtggaacacgggttttcccaggccgatattgtgaagatagccgggaatgggggggggacacaggcgctgcatgccgtcctggatctggagaggatgctgggcgagagagggttctccagagctgacatcgtcaacgtcgccgggaacggagggggagcacaggctttgaaggctgtactggaacatgaggctaccctgaatgagaggggattcaaccttactgatattgttgaaatggctgctaatatcggaggcgctcaagctctcaaagccgtgctcgaacatggacccactctgcggcaacggggcctcagcttgattgacatcgttgagattgccggaaacggtgggggtgcccaggccctcaaagcagtcctgaagtacgggccagttctcatgcaggccgggagaagcaatgaggaaatcgtccatgtggccgctagaaggggcggagccggcaggattcggaaaatggtggcccctctcctggagcggcagggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 221 - DNA, 2628 bp, artificial sequence
  Description of artificial sequence: synthetic polynucleotide
atgggcgatcctaaaaagaaacgtaaggtcatcgattacccatacgatgttccagattacgctatcgatatcgcctcaaccgccttcgtggaccaggataagcaaatggccaaccgcttgaacctgagtcccctggagaggtctaagattgagaagcagtacggcggggccacaactctggcctttatctccaacaagcagaacgagctggcccagatccttagccgggcagacatcttgaagattgcctcctatgattgtgctgcacacgccctccaggctgtcctcgattgcgggccaatgctggggaagagaggattctcccagtcagatatagtcaagatagcaggaaacatcggtggcgctcaggcgttgcaagcggttctcgacctggagagcatgctgggcaagaggggcttttcacgcgacgacattgctaagatggctgggaacggcggcggggcccagacacttcaggcagtactggacctggagtcagcttttcgagagcgcggcttctcccaggcagacatagtgaaaatcgcaggcaacattggaggcgcacaagccctgtacagtgtgctggacgtggagccaactctggggaagcgggggttttctagagcagatattgtcaagattgcagggaacggtggcggtgcgcaagccctgcacactgtgctggatcttgaacctgcgcttggtaagagaggattctctcgcatcgacatcgtaaagattgcggccaacggaggcggggctcaggctctccacgccgtactggacttgggccccacgctccgagagtgtgggttcagccaggccaccatcgctaagatcgccggtaacgggggcggggcacaggcactccagatggtgcttgatctgggcccggccctgggcaaacgcgggttctcccaagctacgattgccaagatcgcaggaaatatcggcggagcgcaggctcttcagaccgtgctggaccttgagcctgccttgtgcgagcgcgggtttagtcaggccacaattgccaaaatggctggcaatattggaggtgcccaagctctccagactgtgcttgacctggaacccgccctccgaaaaagggattttcggcaggccgacatcatcaaaattgcgggcaacaacggtggagcgcaagccttgcaagcagttatcgaacacgggccaaccctgcggcagcatggctttaacctcgccgacatcgtgaagatggccggacacgacggtggcgcacaggccctccaggccgtcttggatctgaagccagttcttgatgagcacggatttagccagcctgacattgtgaaaatggccgggaatatcggtggagcacaagcactccaggctgtcctgagtctgggtccagctctgcgggaacggggcttctctcaacctgacatagtcaaaatcgctggtcatgatggcggtgctcaggcattgcaggccgttctcgatctggagctgaccctcgtggaacacgggttttcccaggccgatattgtgaagatagccgggaatgggggggggacacaggcgctgcatgccgtcctggatctggagaggatgctgggcgagagagggttctccagagctgacatcgtcaacgtcgccgggaacggagggggagcacaggctttgaaggctgtactggaacatgaggctaccctgaatgagaggggattcaaccttactgatattgttgaaatggctgctaatatcggaggcgctcaagctctcaaagccgtgctcgaacatggacccactctgcggcaacggggcctcagcttgattgacatcgttgagattgccggaaacggtgggggtgcccaggccctcaaagcagtcctgaagtacgggccagttctcatgcaggccgggagaagcaatgaggaaatcgtccatgtggccgctagaaggggcggagccggcaggattcggaaaatggtggcccctctcctggagcggcagggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 222 - DNA, 49 bp, artificial sequence
  Description of artificial sequence: synthetic polynucleotide
tgtttatggttacttatatgtgtgtaacaggtataagtaaccataaaca

SEQ ID NO: 223 - DNA, 49 bp, artificial sequence
  Description of artificial sequence: synthetic polynucleotide
tatatttaagcacttatatgtgtgtaacaggtataagtgcttaaatata

SEQ ID NO: 224 - DNA, 1605 bp, artificial sequence
  Description of artificial sequence: synthetic polynucleotide
accgcgtctctctcccgagccgatattgtcaaaatcgcaggcaacaatggaggggctcaagccctgcaagctgtactggatctggaaagtacccttggcaaaagggggttcagccgcgctgacatcgtgaaaatagccgggaacggcggcggagcacaagcattgcaggccgttctggacctggaaagcaccttgggcaaacgcggctttagccgggcagacattgtcaagatcgctggcaacggaggtggcgcccaggcgctgcaagccgtgctcgatctggagagtacactcggtaagcgaggcttttcaagagctgacattgttaagattgccggaaatgggggcggtgcacaggctcttcaagcagtgctggatttggaatccactctggggaagcggggctttagcagagcggacatcgtaaaaatcgccggtaatatcggaggtgcccaggccctacaggcagtgcttgacctggagagcaccctggggaaaagaggcttctcccgagccgacatagtgaagatcgccgggaatggtggaggggcacaggccctccaggcagtgttggatcttgagtccacacttggcaagcggggtttcagtcgcgccgacattgtgaaaatcgcggggaacaatgggggagcccaggctctgcaagcagttctggatctcgaatccacactcgggaagagaggattttctagagctgacatcgttaagatcgctggcaacaacggtggcgcacaggcccttcaggcagtgctcgacctggagagtacgctgggaaagcgcggcttctccagggcagatattgtcaaaattgcaggcaatgggggcggggcacaggcgctccaggcggttcttgatcttgaaagcacactggggaagcgaggatttagccgggccgatatagtaaaaattgccggaaatggcggaggagcccaggctttgcaggccgtccttgatctggagtctaccttgggcaagcgaggcttctcacgcgccgacatcgtgaagattgccggtaatatcggcggcgcccaggcacttcaggccgtgctggatttggagtcaaccctggggaaacggggtttttccagagcagacatagtgaaaatcgccggccatgatgggggcgctcaggccctgcaagcggtcctggatcttgagtcaaccttgggaaaaagaggcttcagtcgcgctgatatagtcaaaatagccggtaacgggggcggagcccaagccctccaggctgttctggacctggaatccactctcggaaaaagggggttcagtcgggcggacatcgtcaagattgctggaaacggagggggggctcaagctctgcaagccgtactcgacttggagtccacactcgggaaaaggggattttctcgggctgacattgtgaagatcgcaggcaacatcggcggggcccaggctctccaggccgtgttggatctggaaagcactctgggtaagcgggggctgtctctgattgacatcgtggagatcgccgggaacgggggaggggctcaggcacttaaggcggtgctcaagtacggtcccgtgctgatgcaggccgggagaggagacgcc

SEQ ID NO: 225 - DNA, 1605 bp, artificial sequence
  Description of artificial sequence: synthetic polynucleotide
accgcgtctctctcccaggcagacatcgtcaagatcgctggaaataatgggggagcacaggctcttcaagccgtcctggacctggagcctacactgcgcgagaggggcttttctcaagccgatatagtgaaaattgcgggcaacggaggaggcgcccaggcgctgcaagctgttctggatttggagcccaccctgcgcgaacgcggattttctcaggctgacatcgtgaagatcgccggtaatggagggggagcccaggcattgcaggccgtgctcgacctggaaccgacactccgggagagaggtttctcccaagccgacatagtgaagatagcaggaaacggggggggtgctcaggccctccaggctgtcctcgatttggaacctacccttagggaacgcggcttcagccaagctgatattgtgaaaatcgcagggaatatcggcggggcacaagcgttgcaggctgtgctggatctggagccaactctcagagagcgagggtttagccaggccgacattgtcaaaatagccgggaatggtgggggcgcacaggccctgcaagcggtgctcgatctggaacccacgctgagagaacgaggcttctcccaggcggacatcgtaaaaattgccgggaacaatggcggggcccaggctttgcaggcagttctggatcttgaacctacactgagggagaggggtttctctcaagccgacattgtaaaaatcgctggaaataatggcggggcccaagctctccaggccgtgcttgaccttgagcctacgctcagggagaggggcttctctcaggccgatatagtgaagatcgcagggaatggggggggcgctcaagcccttcaggctgtcctggatctggagcctacattgcgagagcgggggttctcccaggcagacattgtcaagattgccgggaacggcgggggggcccaggcgttgcaggcggtgctggatcttgagccgactctccgggagcgcggcttcagtcaggccgacatcgtaaagatcgccgggaatatcggaggcgcccaggcactccaggctgtgctcgatctcgaaccaaccctgcgggagcggggttttagccaggcggacatcgtgaaaattgccggccatgacggtggtgcacaagccctgcaagctgtcttggacctcgaacccacactgcgagaaagaggattttcacaggcggatatagttaagatcgctggcaacgggggcggggctcaagcacttcaggccgttctggatttggagcccaccctgcgcgaaagaggcttcagccaggctgacatcgtcaagatagccggcaacggaggcggagcccaggctcttcaggcagtgctcgaccttgaaccaactctgagagagcgcggattttcccaagctgacattgtgaagattgcagggaacatcggaggtgctcaggcactgcaagccgtcctcgatttggaacctaccctgagggagagaggactgagtctgatcgacatcgttgaaatcgcggggaacggtggaggcgcacaggccctgaaagccgtgctgaaatacggacccgtgctgatgcaggcagggagaggagacgcc

SEQ ID NO: 226 - DNA, 1605 bp, artificial sequence
  Description of artificial sequence: synthetic polynucleotide
accgcgtctctctcccagtccgacatcgtcaagatcgctggaaataatgggggagcacaggctcttcaagccgtcctggacctggagtctatgctggggaagaggggcttttctcaagccgatatagtgaaaattgcgggcaacggaggaggcgcccaggcgctgcaagctgttctggatttggagcccaccctgcgcgaacgcggattttctcaggctgacatcgtgaagatcgccggtaatggagggggagcccaggcattgcaggccgtgctcgacctggaaccgacactccgggagagaggtttctcccaagccgacatagtgaagatagcaggaaacggggggggtgctcaggccctccaggctgtcctcgatttggaacctacccttagggaacgcggcttcagccaagctgatattgtgaaaatcgcagggaatatcggcggggcacaagcgttgcaggctgtgctggatctggagccaactctcagagagcgagggtttagccaggccgacattgtcaaaatagccgggaatggtgggggcgcacaggccctgcaagcggtgctcgatctggaacccacgctgagagaacgaggcttctcccaggcggacatcgtaaaaattgccgggaacaatggcggggcccaggctttgcaggcagttctggatcttgaacctacactgagggagaggggtttctctcaagccgacattgtaaaaatcgctggaaataatggcggggcccaagctctccaggccgtgcttgaccttgagcctacgctcagggagaggggcttctctcaggccgatatagtgaagatcgcagggaatggggggggcgctcaagcccttcaggctgtcctggatctggagcctacattgcgagagcgggggttctcccaggcagacattgtcaagattgccgggaacggcgggggggcccaggcgttgcaggcggtgctggatcttgagccgactctccgggagcgcggcttcagtcaggccgacatcgtaaagatcgccgggaatatcggaggcgcccaggcactccaggctgtgctcgatctcgaaccaaccctgcgggagcggggttttagccaggcggacatcgtgaaaattgccggccatgacggtggtgcacaagccctgcaagctgtcttggacctcgaacccacactgcgagaaagaggattttcacaggcggatatagttaagatcgctggcaacgggggcggggctcaagcacttcaggccgttctggatttggagcccaccctgcgcgaaagaggcttcagccaggctgacatcgtcaagatagccggcaacggaggcggagcccaggctcttcaggcagtgctcgaccttgaaccaactctgagagagcgcggatttaacttgactgacattgtggagatggcagcaaacatcggaggtgctcaggcactgaaggccgtcctcgaacacggccctaccctgaggcaaagaggactgagtctgatcgacatcgttgaaatcgcggggaacggtggaggcgcacaggccctgaaagccgtgctgaaatacggacccgtgctgatgcaggcagggagaggagacgcc

SEQ ID NO: 227 - DNA, 2628 bp, artificial sequence
  Description of artificial sequence: synthetic polynucleotide
atgggcgatcctaaaaagaaacgtaaggtcatcgattacccatacgatgttccagattacgctatcgatatcgcctcaaccgccttcgtggaccaggataagcaaatggccaaccgcttgaacctgagtcccctggagaggtctaagattgagaagcagtacggcggggccacaactctggcctttatctccaacaagcagaacgagctggcccagatccttagccgggcagacatcttgaagattgcctcctatgattgtgctgcacacgccctccaggctgtcctcgattgcgggccaatgctggggaagagaggattctcccgagccgatattgtcaaaatcgcaggcaacaatggaggggctcaagccctgcaagctgtactggatctggaaagtacccttggcaaaagggggttcagccgcgctgacatcgtgaaaatagccgggaacggcggcggagcacaagcattgcaggccgttctggacctggaaagcaccttgggcaaacgcggctttagccgggcagacattgtcaagatcgctggcaacggaggtggcgcccaggcgctgcaagccgtgctcgatctggagagtacactcggtaagcgaggcttttcaagagctgacattgttaagattgccggaaatgggggcggtgcacaggctcttcaagcagtgctggatttggaatccactctggggaagcggggctttagcagagcggacatcgtaaaaatcgccggtaatatcggaggtgcccaggccctacaggcagtgcttgacctggagagcaccctggggaaaagaggcttctcccgagccgacatagtgaagatcgccgggaatggtggaggggcacaggccctccaggcagtgttggatcttgagtccacacttggcaagcggggtttcagtcgcgccgacattgtgaaaatcgcggggaacaatgggggagcccaggctctgcaagcagttctggatctcgaatccacactcgggaagagaggattttctagagctgacatcgttaagatcgctggcaacaacggtggcgcacaggcccttcaggcagtgctcgacctggagagtacgctgggaaagcgcggcttctccagggcagatattgtcaaaattgcaggcaatgggggcggggcacaggcgctccaggcggttcttgatcttgaaagcacactggggaagcgaggatttagccgggccgatatagtaaaaattgccggaaatggcggaggagcccaggctttgcaggccgtccttgatctggagtctaccttgggcaagcgaggcttctcacgcgccgacatcgtgaagattgccggtaatatcggcggcgcccaggcacttcaggccgtgctggatttggagtcaaccctggggaaacggggtttttccagagcagacatagtgaaaatcgccggccatgatgggggcgctcaggccctgcaagcggtcctggatcttgagtcaaccttgggaaaaagaggcttcagtcgcgctgatatagtcaaaatagccggtaacgggggcggagcccaagccctccaggctgttctggacctggaatccactctcggaaaaagggggttcagtcgggcggacatcgtcaagattgctggaaacggagggggggctcaagctctgcaagccgtactcgacttggagtccacactcgggaaaaggggattttctcgggctgacattgtgaagatcgcaggcaacatcggcggggcccaggctctccaggccgtgttggatctggaaagcactctgggtaagcgggggctgtctctgattgacatcgtggagatcgccgggaacgggggaggggctcaggcacttaaggcggtgctcaagtacggtcccgtgctgatgcaggccgggagaagcaatgaggaaatcgtccatgtggccgctagaaggggcggagccggcaggattcggaaaatggtggcccctctcctggagcggcagggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 228 - DNA, 2628 bp, artificial sequence
  Description of artificial sequence: synthetic polynucleotide
atgggcgatcctaaaaagaaacgtaaggtcatcgattacccatacgatgttccagattacgctatcgatatcgcctcaaccgccttcgtggaccaggataagcaaatggccaaccgcttgaacctgagtcccctggagaggtctaagattgagaagcagtacggcggggccacaactctggcctttatctccaacaagcagaacgagctggcccagatccttagccgggcagacatcttgaagattgcctcctatgattgtgctgcacacgccctccaggctgtcctcgattgcgggccaatgctggggaagagaggattctcccaggcagacatcgtcaagatcgctggaaataatgggggagcacaggctcttcaagccgtcctggacctggagcctacactgcgcgagaggggcttttctcaagccgatatagtgaaaattgcgggcaacggaggaggcgcccaggcgctgcaagctgttctggatttggagcccaccctgcgcgaacgcggattttctcaggctgacatcgtgaagatcgccggtaatggagggggagcccaggcattgcaggccgtgctcgacctggaaccgacactccgggagagaggtttctcccaagccgacatagtgaagatagcaggaaacggggggggtgctcaggccctccaggctgtcctcgatttggaacctacccttagggaacgcggcttcagccaagctgatattgtgaaaatcgcagggaatatcggcggggcacaagcgttgcaggctgtgctggatctggagccaactctcagagagcgagggtttagccaggccgacattgtcaaaatagccgggaatggtgggggcgcacaggccctgcaagcggtgctcgatctggaacccacgctgagagaacgaggcttctcccaggcggacatcgtaaaaattgccgggaacaatggcggggcccaggctttgcaggcagttctggatcttgaacctacactgagggagaggggtttctctcaagccgacattgtaaaaatcgctggaaataatggcggggcccaagctctccaggccgtgcttgaccttgagcctacgctcagggagaggggcttctctcaggccgatatagtgaagatcgcagggaatggggggggcgctcaagcccttcaggctgtcctggatctggagcctacattgcgagagcgggggttctcccaggcagacattgtcaagattgccgggaacggcgggggggcccaggcgttgcaggcggtgctggatcttgagccgactctccgggagcgcggcttcagtcaggccgacatcgtaaagatcgccgggaatatcggaggcgcccaggcactccaggctgtgctcgatctcgaaccaaccctgcgggagcggggttttagccaggcggacatcgtgaaaattgccggccatgacggtggtgcacaagccctgcaagctgtcttggacctcgaacccacactgcgagaaagaggattttcacaggcggatatagttaagatcgctggcaacgggggcggggctcaagcacttcaggccgttctggatttggagcccaccctgcgcgaaagaggcttcagccaggctgacatcgtcaagatagccggcaacggaggcggagcccaggctcttcaggcagtgctcgaccttgaaccaactctgagagagcgcggattttcccaagctgacattgtgaagattgcagggaacatcggaggtgctcaggcactgcaagccgtcctcgatttggaacctaccctgagggagagaggactgagtctgatcgacatcgttgaaatcgcggggaacggtggaggcgcacaggccctgaaagccgtgctgaaatacggacccgtgctgatgcaggcagggagaagcaatgaggaaatcgtccatgtggccgctagaaggggcggagccggcaggattcggaaaatggtggcccctctcctggagcggcagggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 229 - DNA, 2628 bp, artificial sequence
  Description of artificial sequence: synthetic polynucleotide
atgggcgatcctaaaaagaaacgtaaggtcatcgattacccatacgatgttccagattacgctatcgatatcgcctcaaccgccttcgtggaccaggataagcaaatggccaaccgcttgaacctgagtcccctggagaggtctaagattgagaagcagtacggcggggccacaactctggcctttatctccaacaagcagaacgagctggcccagatccttagccgggcagacatcttgaagattgcctcctatgattgtgctgcacacgccctccaggctgtcctcgattgcgggccaatgctggggaagagaggattctcccagtccgacatcgtcaagatcgctggaaataatgggggagcacaggctcttcaagccgtcctggacctggagtctatgctggggaagaggggcttttctcaagccgatatagtgaaaattgcgggcaacggaggaggcgcccaggcgctgcaagctgttctggatttggagcccaccctgcgcgaacgcggattttctcaggctgacatcgtgaagatcgccggtaatggagggggagcccaggcattgcaggccgtgctcgacctggaaccgacactccgggagagaggtttctcccaagccgacatagtgaagatagcaggaaacggggggggtgctcaggccctccaggctgtcctcgatttggaacctacccttagggaacgcggcttcagccaagctgatattgtgaaaatcgcagggaatatcggcggggcacaagcgttgcaggctgtgctggatctggagccaactctcagagagcgagggtttagccaggccgacattgtcaaaatagccgggaatggtgggggcgcacaggccctgcaagcggtgctcgatctggaacccacgctgagagaacgaggcttctcccaggcggacatcgtaaaaattgccgggaacaatggcggggcccaggctttgcaggcagttctggatcttgaacctacactgagggagaggggtttctctcaagccgacattgtaaaaatcgctggaaataatggcggggcccaagctctccaggccgtgcttgaccttgagcctacgctcagggagaggggcttctctcaggccgatatagtgaagatcgcagggaatggggggggcgctcaagcccttcaggctgtcctggatctggagcctacattgcgagagcgggggttctcccaggcagacattgtcaagattgccgggaacggcgggggggcccaggcgttgcaggcggtgctggatcttgagccgactctccgggagcgcggcttcagtcaggccgacatcgtaaagatcgccgggaatatcggaggcgcccaggcactccaggctgtgctcgatctcgaaccaaccctgcgggagcggggttttagccaggcggacatcgtgaaaattgccggccatgacggtggtgcacaagccctgcaagctgtcttggacctcgaacccacactgcgagaaagaggattttcacaggcggatatagttaagatcgctggcaacgggggcggggctcaagcacttcaggccgttctggatttggagcccaccctgcgcgaaagaggcttcagccaggctgacatcgtcaagatagccggcaacggaggcggagcccaggctcttcaggcagtgctcgaccttgaaccaactctgagagagcgcggatttaacttgactgacattgtggagatggcagcaaacatcggaggtgctcaggcactgaaggccgtcctcgaacacggccctaccctgaggcaaagaggactgagtctgatcgacatcgttgaaatcgcggggaacggtggaggcgcacaggccctgaaagccgtgctgaaatacggacccgtgctgatgcaggcagggagaagcaatgaggaaatcgtccatgtggccgctagaaggggcggagccggcaggattcggaaaatggtggcccctctcctggagcggcagggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 230 - protein, 33 aa, artificial sequence
  Description of artificial sequence: synthetic polypeptide
  misc_feature (12)..(13): Xaa can be any naturally occurring amino acid
FSRADIVKIAGXXGGAQALQAVLDLESTLGKRG

SEQ ID NO: 231 - protein, 33 aa, artificial sequence
  Description of artificial sequence: synthetic polypeptide
  misc_feature (12)..(13): Xaa can be any naturally occurring amino acid
FSQADIVKIAGXXGGAQALQAVLDLEPTLRERG

SEQ ID NO: 232 - DNA, 1086 bp, artificial sequence; identical to SEQ ID NO: 124
  Description of artificial sequence: synthetic polynucleotide

SEQ ID NO: 233 - DNA, 1104 bp, artificial sequence
  Description of artificial sequence: synthetic polynucleotide
atgggcgatcctaaaaagaaacgtaaggtcatcgataaggagaccgccgctgccaagttcgagagacagcacatggacagcatcgatatcgcctcaaccgccttcgtggaccaggataagcaaatggccaaccgcttgaacctgagtcccctggagaggtctaagattgagaagcagtacggcggggccacaactctggcctttatctccaacaagcagaacgagctggcccagatccttagccgggcagacatcttgaagattgcctcctatgattgtgctgcacacgccctccaggctgtcctcgattgcgggccaatgctggggaagagaggattctccggagacgcccgggggatcaggtcacgtgcgtctcggagaagcaatgaggaaatcgtccatgtggccgctagaaggggcggagccggcaggattcggaaaatggtggcccctctcctggagcggcagggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 234 - DNA, 92 bp, artificial sequence
  Description of artificial sequence: synthetic polynucleotide
ccatgggcgatcctaaaaagaaacgtaaggtcatcgataaggagaccgccgctgccaagttcgagagacagcacatggacagcatcgatatc

SEQ ID NO: 235 - DNA, 2628 bp, artificial sequence; identical to SEQ ID NO: 221
  Description of artificial sequence: synthetic polynucleotide

SEQ ID NO: 236 - skipped

SEQ ID NO: 237 - DNA, 60 bp, artificial sequence
  Description of artificial sequence: synthetic polynucleotide
aaccccattgtccgggaacccagagctcacagccacgatcttagacccgagcccacagag

SEQ ID NO: 238 - DNA, 1605 bp, artificial sequence
  Description of artificial sequence: synthetic polynucleotide
accgcgtctctctcccagagtgatattgtcaaaattgcaggacatgacggaggagcccaagctctgcaagccgtgcttgacctggagagcatgttgggcaaaagaggcttttccagggacgatattgccaaaatggccgggcacgatggaggcgctcagacattgcaggctgtcctcgacttggagagcgcttttagggagcggggcttctcccaggccgacattgtgaaaattgccgggaacaacgggggagcccaggcactgtactccgtcctcgacgtggaacctacccttggaaagaggggctttagccgggctgatattgtgaagatcgcaggaaacaacggcggcgctcaagcactgcataccgtgctcgatctggagcccgccctcggaaaaagagggttctctagaatcgacatcgtgaaaatcgccgccaacaacggaggcgcccaggccctgcacgccgtgctggatttggggccaacccttcgcgaatgcggcttttcacaggctaccatcgcaaagatcgctgggaatatcggcggggcccaggctttgcagatggtcctggacttgggcccagccctgggaaagagaggcttcagccaggccactattgccaagatcgccggcaacattggcggcgcacaggctctccagacagtgttggacctcgaacccgcactttgcgagagggggttttcccaggccaccatcgccaagatggctggccacgatggcggagcacaagccctgcaaactgtgctcgatttggagccagccctgcggaagagagacttccggcaggctgacattattaagattgcaggccatgatgggggagcccaagcacttcaggcagtcattgaacatggacctacattgcgccagcatggattcaacctcgccgacattgtcaagatggctggccatgacgggggcgcccaggccctgcaagccgtcctggatctgaagcctgtgttggacgagcacggcttcagccagccagacattgtgaagatggccggaaatattggcggggcacaggctcttcaggccgtgctttccttggggcccgctctccgggagcggggctttagccagcctgatattgtgaaaatcgcaggcaacaacggcggagcacaggccctccaggcagtgctggatctcgaactcaccttggtggagcatgggttcagtcaggccgatattgtcaaaattgctggaaacatcggcggaacccaagctctccacgctgtgctcgacctggaaaggatgctcggggagagagggtttagcagggctgacatcgtgaacgtggccggcaacaatggaggggcccaagccctgaaggctgtgctggagcacgaagccactctgaacgagcgcgggttcaacctgaccgacatcgtggagatggccgcccacgacggaggcgctcaggcactgaaggccgtcttggagcacgggcctacactcagacagcggggcctgtccttgattgacattgtcgagattgcaggcaatgggggaggagcccaggctctcaaggctgtgttgaagtacggccccgtcctcatgcaggccgggagaggagacgcc

SEQ ID NO: 239 - DNA, 1605 bp, artificial sequence
  Description of artificial sequence: synthetic polynucleotide
accgcgtctctctcccagagtgatattgtcaaaattgcaggacatgacggaggagcccaagctctgcaagccgtgcttgacctggagagcatgttgggcaaaagaggcttttccagggacgatattgccaaaatggccgggaacggaggaggcgctcagacattgcaggctgtcctcgacttggagagcgcttttagggagcggggcttctcccaggccgacattgtgaaaattgccgggaacaacgggggagcccaggcactgtactccgtcctcgacgtggaacctacccttggaaagaggggctttagccgggctgatattgtgaagatcgcaggaaacgggggcggcgctcaagcactgcataccgtgctcgatctggagcccgccctcggaaaaagagggttctctagaatcgacatcgtgaaaatcgccgccaacaacggaggcgcccaggccctgcacgccgtgctggatttggggccaacccttcgcgaatgcggcttttcacaggctaccatcgcaaagatcgctgggaataatggcggggcccaggctttgcagatggtcctggacttgggcccagccctgggaaagagaggcttcagccaggccactattgccaagatcgccggcaacaacggcggcgcacaggctctccagacagtgttggacctcgaacccgcactttgcgagagggggttttcccaggccaccatcgccaagatggctggccacgatggcggagcacaagccctgcaaactgtgctcgatttggagccagccctgcggaagagagacttccggcaggctgacattattaagattgcaggcaatggagggggagcccaagcacttcaggcagtcattgaacatggacctacattgcgccagcatggattcaacctcgccgacattgtcaagatggctggccatgacgggggcgcccaggccctgcaagccgtcctggatctgaagcctgtgttggacgagcacggcttcagccagccagacattgtgaagatggccggaaataacggcggggcacaggctcttcaggccgtgctttccttggggcccgctctccgggagcggggctttagccggcctgatattgtgaaaatcgcaggcaacaacggcggagcacaggccctccaggcagtgctggatctcgaactcaccttggtggagcatgggttcagtcaggccgatattgtcaaaattgctggaaacaatggcggaacccaagctctccacgctgtgctcgacctggaaaggatgctcggggagagagggtttagcagggctgacatcgtgaacgtggccggcaacggaggaggggcccaagccctgaaggctgtgctggagcacgaagccactctgaacgagcgcgggttcaacctgaccgacatcgtggagatggccgcccacgacggaggcgctcaggcactgaaggccgtcttggagcacgggcctacactcagacagcggggcctgtccttgattgacattgtcgagattgcaggcaatgggggaggagcccaggctctcaaggctgtgttgaagtacggccccgtcctcatgcaggccgggagaggagacgcc

SEQ ID NO: 240 - DNA, 2628 bp, artificial sequence
  Description of artificial sequence: synthetic polynucleotide
atgggcgatcctaaaaagaaacgtaaggtcatcgattacccatacgatgttccagattacgctatcgatatcgcctcaaccgccttcgtggaccaggataagcaaatggccaaccgcttgaacctgagtcccctggagaggtctaagattgagaagcagtacggcggggccacaactctggcctttatctccaacaagcagaacgagctggcccagatccttagccgggcagacatcttgaagattgcctcctatgattgtgctgcacacgccctccaggctgtcctcgattgcgggccaatgctggggaagagaggattctcccagagtgatattgtcaaaattgcaggacatgacggaggagcccaagctctgcaagccgtgcttgacctggagagcatgttgggcaaaagaggcttttccagggacgatattgccaaaatggccgggcacgatggaggcgctcagacattgcaggctgtcctcgacttggagagcgcttttagggagcggggcttctcccaggccgacattgtgaaaattgccgggaacaacgggggagcccaggcactgtactccgtcctcgacgtggaacctacccttggaaagaggggctttagccgggctgatattgtgaagatcgcaggaaacaacggcggcgctcaagcactgcataccgtgctcgatctggagcccgccctcggaaaaagagggttctctagaatcgacatcgtgaaaatcgccgccaacaacggaggcgcccaggccctgcacgccgtgctggatttggggccaacccttcgcgaatgcggcttttcacaggctaccatcgcaaagatcgctgggaatatcggcggggcccaggctttgcagatggtcctggacttgggcccagccctgggaaagagaggcttcagccaggccactattgccaagatcgccggcaacattggcggcgcacaggctctccagacagtgttggacctcgaacccgcactttgcgagagggggttttcccaggccaccatcgccaagatggctggccacgatggcggagcacaagccctgcaaactgtgctcgatttggagccagccctgcggaagagagacttccggcaggctgacattattaagattgcaggccatgatgggggagcccaagcacttcaggcagtcattgaacatggacctacattgcgccagcatggattcaacctcgccgacattgtcaagatggctggccatgacgggggcgcccaggccctgcaagccgtcctggatctgaagcctgtgttggacgagcacggcttcagccagccagacattgtgaagatggccggaaatattggcggggcacaggctcttcaggccgtgctttccttggggcccgctctccgggagcggggctttagccagcctgatattgtgaaaatcgcaggcaacaacggcggagcacaggccctccaggcagtgctggatctcgaactcaccttggtggagcatgggttcagtcaggccgatattgtcaaaattgctggaaacatcggcggaacccaagctctccacgctgtgctcgacctggaaaggatgctcggggagagagggtttagcagggctgacatcgtgaacgtggccggcaacaatggaggggcccaagccctgaaggctgtgctggagcacgaagccactctgaacgagcgcgggttcaacctgaccgacatcgtggagatggccgcccacgacggaggcgctcaggcactgaaggccgtcttggagcacgggcctacactcagacagcggggcctgtccttgattgacattgtcgagattgcaggcaatgggggaggagcccaggctctcaaggctgtgttgaagtacggccccgtcctcatgcaggccgggagaagcaatgaggaaatcgtccatgtggccgctagaaggggcggagccggcaggattcggaaaatggtggcccctctcctggagcggcagggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 241 - DNA, 2628 bp, artificial sequence
  Description of artificial sequence: synthetic polynucleotide
atgggcgatcctaaaaagaaacgtaaggtcatcgattacccatacgatgttccagattacgctatcgatatcgcctcaaccgccttcgtggaccaggataagcaaatggccaaccgcttgaacctgagtcccctggagaggtctaagattgagaagcagtacggcggggccacaactctggcctttatctccaacaagcagaacgagctggcccagatccttagccgggcagacatcttgaagattgcctcctatgattgtgctgcacacgccctccaggctgtcctcgattgcgggccaatgctggggaagagaggattctcccagagtgatattgtcaaaattgcaggacatgacggaggagcccaagctctgcaagccgtgcttgacctggagagcatgttgggcaaaagaggcttttccagggacgatattgccaaaatggccgggaacggaggaggcgctcagacattgcaggctgtcctcgacttggagagcgcttttagggagcggggcttctcccaggccgacattgtgaaaattgccgggaacaacgggggagcccaggcactgtactccgtcctcgacgtggaacctacccttggaaagaggggctttagccgggctgatattgtgaagatcgcaggaaacgggggcggcgctcaagcactgcataccgtgctcgatctggagcccgccctcggaaaaagagggttctctagaatcgacatcgtgaaaatcgccgccaacaacggaggcgcccaggccctgcacgccgtgctggatttggggccaacccttcgcgaatgcggcttttcacaggctaccatcgcaaagatcgctgggaataatggcggggcccaggctttgcagatggtcctggacttgggcccagccctgggaaagagaggcttcagccaggccactattgccaagatcgccggcaacaacggcggcgcacaggctctccagacagtgttggacctcgaacccgcactttgcgagagggggttttcccaggccaccatcgccaagatggctggccacgatggcggagcacaagccctgcaaactgtgctcgatttggagccagccctgcggaagagagacttccggcaggctgacattattaagattgcaggcaatggagggggagcccaagcacttcaggcagtcattgaacatggacctacattgcgccagcatggattcaacctcgccgacattgtcaagatggctggccatgacgggggcgcccaggccctgcaagccgtcctggatctgaagcctgtgttggacgagcacggcttcagccagccagacattgtgaagatggccggaaataacggcggggcacaggctcttcaggccgtgctttccttggggcccgctctccgggagcggggctttagccggcctgatattgtgaaaatcgcaggcaacaacggcggagcacaggccctccaggcagtgctggatctcgaactcaccttggtggagcatgggttcagtcaggccgatattgtcaaaattgctggaaacaatggcggaacccaagctctccacgctgtgctcgacctggaaaggatgctcggggagagagggtttagcagggctgacatcgtgaacgtggccggcaacggaggaggggcccaagccctgaaggctgtgctggagcacgaagccactctgaacgagcgcgggttcaacctgaccgacatcgtggagatggccgcccacgacggaggcgctcaggcactgaaggccgtcttggagcacgggcctacactcagacagcggggcctgtccttgattgacattgtcgagattgcaggcaatgggggaggagcccaggctctcaaggctgtgttgaagtacggccccgtcctcatgcaggccgggagaagcaatgaggaaatcgtccatgtggccgctagaaggggcggagccggcaggattcggaaaatggtggcccctctcctggagcggcagggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 242 - DNA, 63 bp, artificial sequence
  Description of artificial sequence: synthetic polynucleotide
ccatctcatccctgcgtgtctccgactcagtactgagctacgaaccctcagacctgttcgatc

SEQ ID NO: 243 - DNA, 52 bp, artificial sequence
  Description of artificial sequence: synthetic polynucleotide
cctatcccctgtgtgccttggcagtctcaggtgagatccagagcccagcctg

SEQ ID NO: 244 - DNA, 51 bp, artificial sequence
  Description of artificial sequence: synthetic polynucleotide
gtccgggaacccagagctcacagccacgatcttagacccgagcccacagag

SEQ ID NO: 245 - DNA, 1803 bp, artificial sequence
  Description of artificial sequence: synthetic polynucleotide
accgcgtctctctcccaaagcgacatcgtcaaaattgcagggaataacggaggggcacaagctctgcaagccgtcctcgacctcgaatctatgctcggcaagagggggttttcacgggatgacatcgctaaaatggccgggaacggaggcggagcacagacattgcaggccgtccttgatctggaaagcgcctttagagaaagggggtttagccaggctgacattgtgaagatcgcagggcacgatgggggagcacaggcattgtacagcgtgttggatgtggagcccactctgggcaagcggggattcagtagggccgatattgtcaagatcgccggccacgacgggggggctcaggctcttcatacagtcctcgatttggagccagccctcggaaagcgggggttctcccggattgacatcgtgaaaattgctgccaacaatggcggagcccaggcccttcacgcagtgctcgacttgggccctacactccgcgagtgcggattttcccaggcaacaatcgccaagatcgctgggaacaatggaggcgcccaggcactccaaatggtcttggatctggggcctgccctgggcaaacgcgggtttagtcaggccacaattgcaaaaattgccggaaacaacgggggcgcacaggctctccagactgtgttggacttggagcccgccctgtgcgagaggggcttctcacaggccactatcgcaaaaatggctggcaatattgggggagcccaagccctgcaaaccgtcctggacctcgaacccgccctcagaaagcgggattttcggcaggccgacatcattaagattgccgggaacatcggcggcgctcaggcacttcaggccgtgattgagcatggacccacactccggcagcacggcttcaaccttgccgacattgtcaaaatggctggacatgatggaggcgctcaagcactgcaagcagtgctcgacctgaagccagtgctggacgagcacgggttttctcagcccgacatcgtcaagatggctgggcatgacgggggagcacaagccctccaggctgtcctctctttggggcccgctctgagagagagaggattctcacagccagacatcgtgaagatcgccggccacgatggcggggcacaggccctgcaagccgtgctggacctggaactcaccttggtcgagcatggcttcagtcaggctgacatcgtgaaaatcgccgggaacattgggggcacccaagctcttcacgccgtgctcgatctggagaggatgctgggggagaggggatttagccgcgccgatattgtgaacgtggccggaaataacggaggggctcaggcacttaaggctgtgctggagcacgaggccactttgaacgagcggggctttagccgggcagacattgtgaaaattgccgggaacatcggaggagcacaggctttgaaggccgtcctggagcatgaggctacactggatgagagggggttcagccgggccgatattgtcaacgtcgctggcaacaacggcggggcccaagccctgaaggcagtgttggaacatgaggcaaccctcaacgagagagggttcaacctgactgatattgtcgagatggcagctcatgatggcggcgcccaggccctcaaggctgtcttggagcacggccccacattgaggcagcggggcctgtcacttatcgacatcgtggagatcgcaggcaacggaggcggcgcacaggctctgaaggctgtgttgaagtacggcccagtgctcatgcaggcagggagaggagacgcc

SEQ ID NO: 246 - DNA, 1803 bp, artificial sequence
  Description of artificial sequence: synthetic polynucleotide
accgcgtctctctcccaaagcgacatcgtcaaaattgcagggcatgacggaggggcacaagctctgcaagccgtcctcgacctcgaatctatgctcggcaagagggggttttcacgggatgacatcgctaaaatggccgggaacggaggcggagcacagacattgcaggccgtccttgatctggaaagcgcctttagagaaagggggtttagccaggctgacattgtgaagatcgcagggcacgatgggggagcacaggcattgtacagcgtgttggatgtggagcccactctgggcaagcggggattcagtagggccgatattgtcaagatcgccggcaatggggggggggctcaggctcttcatacagtcctcgatttggagccagccctcggaaagcgggggttctcccggattgacatcgtgaaaattgctgccaacaatggcggagcccaggcccttcacgcagtgctcgacttgggccctacactccgcgagtgcggattttcccaggcaacaatcgccaagatcgctgggaacgggggaggcgcccaggcactccaaatggtcttggatctggggcctgccctgggcaaacgcgggtttagtcaggccacaattgcaaaaattgccggaaacaacgggggcgcacaggctctccagactgtgttggacttggagcccgccctgtgcgagaggggcttctcacaggccactatcgcaaaaatggctggcaataatgggggagcccaagccctgcaaaccgtcctggacctcgaacccgccctcagaaagcgggattttcggcaggccgacatcattaagattgccgggaacaacggcggcgctcaggcacttcaggccgtgattgagcatggacccacactccggcagcacggcttcaaccttgccgacattgtcaaaatggctggacatgatggaggcgctcaagcactgcaagcagtgctcgacctgaagccagtgctggacgagcacgggttttctcagcccgacatcgtcaagatggctgggaacggagggggagcacaagccctccaggctgtcctctctttggggcccgctctgagagagagaggattctcacagccagacatcgtgaagatcgccggccacgatggcggggcacaggccctgcaagccgtgctggacctggaactcaccttggtcgagcatggcttcagtcaggctgacatcgtgaaaatcgccgggaacaatgggggcacccaagctcttcacgccgtgctcgatctggagaggatgctgggggagaggggatttagccgcgccgatattgtgaacgtggccggaaataacggaggggctcaggcacttaaggctgtgctggagcacgaggccactttgaacgagcggggctttagccgggcagacattgtgaaaattgccgggaacaacggaggagcacaggctttgaaggccgtcctggagcatgaggctacactggatgagagggggttcagccgggccgatattgtcaacgtcgctggcaacggcggcggggcccaagccctgaaggcagtgttggaacatgaggcaaccctcaacgagagagggttcaacctgactgatattgtcgagatggcagctcatgatggcggcgcccaggccctcaaggctgtcttggagcacggccccacattgaggcagcggggcctgtcacttatcgacatcgtggagatcgcaggcaacggaggcggcgcacaggctctgaaggctgtgttgaagtacggcccagtgctcatgcaggcagggagaggagacgcc

SEQ ID NO: 247 - DNA, 2826 bp, artificial sequence
  Description of artificial sequence: synthetic polynucleotide
atgggcgatcctaaaaagaaacgtaaggtcatcgattacccatacgatgttccagattacgctatcgatatcgcctcaaccgccttcgtggaccaggataagcaaatggccaaccgcttgaacctgagtcccctggagaggtctaagattgagaagcagtacggcggggccacaactctggcctttatctccaacaagcagaacgagctggcccagatccttagccgggcagacatcttgaagattgcctcctatgattgtgctgcacacgccctccaggctgtcctcgattgcgggccaatgctggggaagagaggattctcccaaagcgacatcgtcaaaattgcagggaataacggaggggcacaagctctgcaagccgtcctcgacctcgaatctatgctcggcaagagggggttttcacgggatgacatcgctaaaatggccgggaacggaggcggagcacagacattgcaggccgtccttgatctggaaagcgcctttagagaaagggggtttagccaggctgacattgtgaagatcgcagggcacgatgggggagcacaggcattgtacagcgtgttggatgtggagcccactctgggcaagcggggattcagtagggccgatattgtcaagatcgccggccacgacgggggggctcaggctcttcatacagtcctcgatttggagccagccctcggaaagcgggggttctcccggattgacatcgtgaaaattgctgccaacaatggcggagcccaggcccttcacgcagtgctcgacttgggccctacactccgcgagtgcggattttcccaggcaacaatcgccaagatcgctgggaacaatggaggcgcccaggcactccaaatggtcttggatctggggcctgccctgggcaaacgcgggtttagtcaggccacaattgcaaaaattgccggaaacaacgggggcgcacaggctctccagactgtgttggacttggagcccgccctgtgcgagaggggcttctcacaggccactatcgcaaaaatggctggcaatattgggggagcccaagccctgcaaaccgtcctggacctcgaacccgccctcagaaagcgggattttcggcaggccgacatcattaagattgccgggaacatcggcggcgctcaggcacttcaggccgtgattgagcatggacccacactccggcagcacggcttcaaccttgccgacattgtcaaaatggctggacatgatggaggcgctcaagcactgcaagcagtgctcgacctgaagccagtgctggacgagcacgggttttctcagcccgacatcgtcaagatggctgggcatgacgggggagcacaagccctccaggctgtcctctctttggggcccgctctgagagagagaggattctcacagccagacatcgtgaagatcgccggccacgatggcggggcacaggccctgcaagccgtgctggacctggaactcaccttggtcgagcatggcttcagtcaggctgacatcgtgaaaatcgccgggaacattgggggcacccaagctcttcacgccgtgctcgatctggagaggatgctgggggagaggggatttagccgcgccgatattgtgaacgtggccggaaataacggaggggctcaggcacttaaggctgtgctggagcacgaggccactttgaacgagcggggctttagccgggcagacattgtgaaaattgccgggaacatcggaggagcacaggctttgaaggccgtcctggagcatgaggctacactggatgagagggggttcagccgggccgatattgtcaacgtcgctggcaacaacggcggggcccaagccctgaaggcagtgttggaacatgaggcaaccctcaacgagagagggttcaacctgactgatattgtcgagatggcagctcatgatggcggcgcccaggccctcaaggctgtcttggagcacggccccacattgaggcagcggggcctgtcacttatcgacatcgtggagatcgcaggcaacggaggcggcgcacaggctctgaaggctgtgttgaagtacggcccagtgctcatgcaggcagggagaagcaatgaggaaatcgtccatgtggccgctagaaggggcggagccggcaggattcggaaaatggtggcccctctcctggagcggcagggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 248 - DNA, 2844 bp, artificial sequence
  Description of artificial sequence: synthetic polynucleotide
atgggcgatcctaaaaagaaacgtaaggtcatcgataaggagaccgccgctgccaagttcgagagacagcacatggacagcatcgatatcgcctcaaccgccttcgtggaccaggataagcaaatggccaaccgcttgaacctgagtcccctggagaggtctaagattgagaagcagtacggcggggccacaactctggcctttatctccaacaagcagaacgagctggcccagatccttagccgggcagacatcttgaagattgcctcctatgattgtgctgcacacgccctccaggctgtcctcgattgcgggccaatgctggggaagagaggattctcccaaagcgacatcgtcaaaattgcagggcatgacggaggggcacaagctctgcaagccgtcctcgacctcgaatctatgctcggcaagagggggttttcacgggatgacatcgctaaaatggccgggaacggaggcggagcacagacattgcaggccgtccttgatctggaaagcgcctttagagaaagggggtttagccaggctgacattgtgaagatcgcagggcacgatgggggagcacaggcattgtacagcgtgttggatgtggagcccactctgggcaagcggggattcagtagggccgatattgtcaagatcgccggcaatggggggggggctcaggctcttcatacagtcctcgatttggagccagccctcggaaagcgggggttctcccggattgacatcgtgaaaattgctgccaacaatggcggagcccaggcccttcacgcagtgctcgacttgggccctacactccgcgagtgcggattttcccaggcaacaatcgccaagatcgctgggaacgggggaggcgcccaggcactccaaatggtcttggatctggggcctgccctgggcaaacgcgggtttagtcaggccacaattgcaaaaattgccggaaacaacgggggcgcacaggctctccagactgtgttggacttggagcccgccctgtgcgagaggggcttctcacaggccactatcgcaaaaatggctggcaataatgggggagcccaagccctgcaaaccgtcctggacctcgaacccgccctcagaaagcgggattttcggcaggccgacatcattaagattgccgggaacaacggcggcgctcaggcacttcaggccgtgattgagcatggacccacactccggcagcacggcttcaaccttgccgacattgtcaaaatggctggacatgatggaggcgctcaagcactgcaagcagtgctcgacctgaagccagtgctggacgagcacgggttttctcagcccgacatcgtcaagatggctgggaacggagggggagcacaagccctccaggctgtcctctctttggggcccgctctgagagagagaggattctcacagccagacatcgtgaagatcgccggccacgatggcggggcacaggccctgcaagccgtgctggacctggaactcaccttggtcgagcatggcttcagtcaggctgacatcgtgaaaatcgccgggaacaatgggggcacccaagctcttcacgccgtgctcgatctggagaggatgctgggggagaggggatttagccgcgccgatattgtgaacgtggccggaaataacggaggggctcaggcacttaaggctgtgctggagcacgaggccactttgaacgagcggggctttagccgggcagacattgtgaaaattgccgggaacaacggaggagcacaggctttgaaggccgtcctggagcatgaggctacactggatgagagggggttcagccgggccgatattgtcaacgtcgctggcaacggcggcggggcccaagccctgaaggcagtgttggaacatgaggcaaccctcaacgagagagggttcaacctgactgatattgtcgagatggcagctcatgatggcggcgcccaggccctcaaggctgtcttggagcacggccccacattgaggcagcggggcctgtcacttatcgacatcgtggagatcgcaggcaacggaggcggcgcacaggctctgaaggctgtgttgaagtacggcccagtgctcatgcaggcagggagaagcaatgaggaaatcgtccatgtggccgctagaaggggcggagccggcaggattcggaaaatggtggcccctctcctggagcggcagggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 249 - DNA, 55 bp, artificial sequence
  Description of artificial sequence: synthetic polynucleotide
ttgtccgggaacccagagctcacagccacgatcttagacccgagcccacagagcc

SEQ ID NO: 250 - DNA, 2001 bp, artificial sequence
  Description of artificial sequence: synthetic polynucleotide
accgcgtctctctcccaaagcgacatcgtcaaaattgcagggaatggcggaggggcacaagctctgcaagccgtcctcgacctcgaatctatgctcggcaagagggggttttcacgggatgacatcgctaaaatggccgggaacggaggcggagcacagacattgcaggccgtccttgatctggaaagcgcctttagagaaagggggtttagccaggctgacattgtgaagatcgcagggaacaatgggggagcacaggcattgtacagcgtgttggatgtggagcccactctgggcaagcggggattcagtagggccgatattgtcaagatcgccggcaatggggggggggctcaggctcttcatacagtcctcgatttggagccagccctcggaaagcgggggttctcccggattgacatcgtgaaaattgctgcccatgacggcggagcccaggcccttcacgcagtgctcgacttgggccctacactccgcgagtgcggattttcccaggcaacaatcgccaagatcgctgggcacgacggaggcgcccaggcactccaaatggtcttggatctggggcctgccctgggcaaacgcgggtttagtcaggccacaattgcaaaaattgccggaaacaacgggggcgcacaggctctccagactgtgttggacttggagcccgccctgtgcgagaggggcttctcacaggccactatcgcaaaaatggctggcaataatgggggagcccaagccctgcaaaccgtcctggacctcgaacccgccctcagaaagcgggattttcggcaggccgacatcattaagattgccgggaacaacggcggcgctcaggcacttcaggccgtgattgagcatggacccacactccggcagcacggcttcaaccttgccgacattgtcaaaatggctggaaacattggaggcgctcaagcactgcaagcagtgctcgacctgaagccagtgctggacgagcacgggttttctcagcccgacatcgtcaagatggctgggaacattgggggagcacaagccctccaggctgtcctctctttggggcccgctctgagagagagaggattctcacagccagacatcgtgaagatcgccggccacgatggcggggcacaggccctgcaagccgtgctggacctggaactcaccttggtcgagcatggcttcagtcagcctgacatcgtgaggatcaccgggcacgacgggggcgcacaagctcttcaggccgtgctcgctctggagttgactctgcgcgagaggggatttagccaaccagatattgtgaagattgccggacacgacggaggggctcaggcacttcaagctgtgctggatcttgagttgacttttagggagcggggctttagccaggcagacattgtgaaaattgccgggaacatcggaggaactcaagccttgcatgctgtgttggatttggaaagaatgctgggggagaggggcttctctcgggcagatattgtcaacgtggctggaaataacggaggagcacaggctttgaaggccgtcctggagcatgaggctacactgaatgagagggggttcagccgggccgatattgtcaagattgctggcaacattggcggggcccaagccctgaaggcagtgttggaacatgaggcaacacttgatgaaagaggattcagcagagctgacattgtgaggattgctgggaacaatggaggagcccaggctcttaaggcagtccttgagcatggcccaaccctcaacgagagagggttcaacctgactgatattgtcgagatggcagctcatgatggcggcgcccaggccctcaaggctgtcttggagcacggccccacattgaggcagcggggcctgtcacttatcgacatcgtggagatcgcatctaacggaggcggcgcacaggctctgaaggctgtgttgaagtacggcccagtgctcatgcaggcagggagaggagacgcc

SEQ ID NO: 251 - DNA, 2001 bp, artificial sequence
  Description of artificial sequence: synthetic polynucleotide
accgcgtctctctcccaaagcgacatcgtcaaaattgcagggaataacggaggggcacaagctctgcaagccgtcctcgacctcgaatctatgctcggcaagagggggttttcacgggatgacatcgctaaaatggccgggaacaatggcggagcacagacattgcaggccgtccttgatctggaaagcgcctttagagaaagggggtttagccaggctgacattgtgaagatcgcagggcacgatgggggagcacaggcattgtacagcgtgttggatgtggagcccactctgggcaagcggggattcagtagggccgatattgtcaagatcgccggcaatggggggggggctcaggctcttcatacagtcctcgatttggagccagccctcggaaagcgggggttctcccggattgacatcgtgaaaattgctgcccatgacggcggagcccaggcccttcacgcagtgctcgacttgggccctacactccgcgagtgcggattttcccaggcaacaatcgccaagatcgctgggaacgggggaggcgcccaggcactccaaatggtcttggatctggggcctgccctgggcaaacgcgggtttagtcaggccacaattgcaaaaattgccggaaacaacgggggcgcacaggctctccagactgtgttggacttggagcccgccctgtgcgagaggggcttctcacaggccactatcgcaaaaatggctggcaatggagggggagcccaagccctgcaaaccgtcctggacctcgaacccgccctcagaaagcgggattttcggcaggccgacatcattaagattgccgggaacaacggcggcgctcaggcacttcaggccgtgattgagcatggacccacactccggcagcacggcttcaaccttgccgacattgtcaaaatggctggaaacaatggaggcgctcaagcactgcaagcagtgctcgacctgaagccagtgctggacgagcacgggttttctcagcccgacatcgtcaagatggctgggaacaacgggggagcacaagccctccaggctgtcctctctttggggcccgctctgagagagagaggattctcacagccagacatcgtgaagatcgccggccacgatggcggggcacaggccctgcaagccgtgctggacctggaactcaccttggtcgagcatggcttcagtcagcctgacatcgtgaggatcaccgggaacggagggggcgcacaagctcttcaggccgtgctcgctctggagttgactctgcgcgagaggggatttagccaaccagatattgtgaagattgccggacacgacggaggggctcaggcacttcaagctgtgctggatcttgagttgacttttagggagcggggctttagccaggcagacattgtgaaaattgccgggaacaacggaggaactcaagccttgcatgctgtgttggatttggaaagaatgctgggggagaggggcttctctcgggcagatattgtcaacgtggctggaaataacggaggagcacaggctttgaaggccgtcctggagcatgaggctacactgaatgagagggggttcagccgggccgatattgtcaagattgctggcaacaacggcggggcccaagccctgaaggcagtgttggaacatgaggcaacacttgatgaaagaggattcagcagagctgacattgtgaggattgctgggaacgggggaggagcccaggctcttaaggcagtccttgagcatggcccaaccctcaacgagagagggttcaacctgactgatattgtcgagatggcagctcatgatggcggcgcccaggccctcaaggctgtcttggagcacggccccacattgaggcagcggggcctgtcacttatcgacatcgtggagatcgcatctaacggaggcggcgcacaggctctgaaggctgtgttgaagtacggcccagtgctcatgcaggcagggagaggagacgcc

SEQ ID NO: 252 - DNA, 3024 bp, artificial sequence
  Description of artificial sequence: synthetic polynucleotide
atgggcgatcctaaaaagaaacgtaaggtcatcgattacccatacgatgttccagattacgctatcgatatcgcctcaaccgccttcgtggaccaggataagcaaatggccaaccgcttgaacctgagtcccctggagaggtctaagattgagaagcagtacggcggggccacaactctggcctttatctccaacaagcagaacgagctggcccagatccttagccgggcagacatcttgaagattgcctcctatgattgtgctgcacacgccctccaggctgtcctcgattgcgggccaatgctggggaagagaggattctcccaaagcgacatcgtcaaaattgcagggaatggcggaggggcacaagctctgcaagccgtcctcgacctcgaatctatgctcggcaagagggggttttcacgggatgacatcgctaaaatggccgggaacggaggcggagcacagacattgcaggccgtccttgatctggaaagcgcctttagagaaagggggtttagccaggctgacattgtgaagatcgcagggaacaatgggggagcacaggcattgtacagcgtgttggatgtggagcccactctgggcaagcggggattcagtagggccgatattgtcaagatcgccggcaatggggggggggctcaggctcttcatacagtcctcgatttggagccagccctcggaaagcgggggttctcccggattgacatcgtgaaaattgctgcccatgacggcggagcccaggcccttcacgcagtgctcgacttgggccctacactccgcgagtgcggattttcccaggcaacaatcgccaagatcgctgggcacgacggaggcgcccaggcactccaaatggtcttggatctggggcctgccctgggcaaacgcgggtttagtcaggccacaattgcaaaaattgccggaaacaacgggggcgcacaggctctccagactgtgttggacttggagcccgccctgtgcgagaggggcttctcacaggccactatcgcaaaaatggctggcaataatgggggagcccaagccctgcaaaccgtcctggacctcgaacccgccctcagaaagcgggattttcggcaggccgacatcattaagattgccgggaacaacggcggcgctcaggcacttcaggccgtgattgagcatggacccacactccggcagcacggcttcaaccttgccgacattgtcaaaatggctggaaacattggaggcgctcaagcactgcaagcagtgctcgacctgaagccagtgctggacgagcacgggttttctcagcccgacatcgtcaagatggctgggaacattgggggagcacaagccctccaggctgtcctctctttggggcccgctctgagagagagaggattctcacagccagacatcgtgaagatcgccggccacgatggcggggcacaggccctgcaagccgtgctggacctggaactcaccttggtcgagcatggcttcagtcagcctgacatcgtgaggatcaccgggcacgacgggggcgcacaagctcttcaggccgtgctcgctctggagttgactctgcgcgagaggggatttagccaaccagatattgtgaagattgccggacacgacggaggggctcaggcacttcaagctgtgctggatcttgagttgacttttagggagcggggctttagccaggcagacattgtgaaaattgccgggaacatcggaggaactcaagccttgcatgctgtgttggatttggaaagaatgctgggggagaggggcttctctcgggcagatattgtcaacgtggctggaaataacggaggagcacaggctttgaaggccgtcctggagcatgaggctacactgaatgagagggggttcagccgggccgatattgtcaagattgctggcaacattggcggggcccaagccctgaaggcagtgttggaacatgaggcaacacttgatgaaagaggattcagcagagctgacattgtgaggattgctgggaacaatggaggagcccaggctcttaaggcagtccttgagcatggcccaaccctcaacgagagagggttcaacctgactgatattgtcgagatggcagctcatgatggcggcgcccaggccctcaaggctgtcttggagcacggccccacattgaggcagcggggcctgtcacttatcgacatcgtggagatcgcatctaacggaggcggcgcacaggctctgaaggctgtgttgaagtacggcccagtgctcatgcaggcagggagaagcaatgaggaaatcgtccatgtggccgctagaaggggcggagccggcaggattcggaaaatggtggcccctctcctggagcggcagggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 253 - DNA, 3042 bp, artificial sequence
  Description of artificial sequence: synthetic polynucleotide
atgggcgatcctaaaaagaaacgtaaggtcatcgataaggagaccgccgctgccaagttcgagagacagcacatggacagcatcgatatcgcctcaaccgccttcgtggaccaggataagcaaatggccaaccgcttgaacctgagtcccctggagaggtctaagattgagaagcagtacggcggggccacaactctggcctttatctccaacaagcagaacgagctggcccagatccttagccgggcagacatcttgaagattgcctcctatgattgtgctgcacacgccctccaggctgtcctcgattgcgggccaatgctggggaagagaggattctcccaaagcgacatcgtcaaaattgcagggaataacggaggggcacaagctctgcaagccgtcctcgacctcgaatctatgctcggcaagagggggttttcacgggatgacatcgctaaaatggccgggaacaatggcggagcacagacattgcaggccgtccttgatctggaaagcgcctttagagaaagggggtttagccaggctgacattgtgaagatcgcagggcacgatgggggagcacaggcattgtacagcgtgttggatgtggagcccactctgggcaagcggggattcagtagggccgatattgtcaagatcgccggcaatggggggggggctcaggctcttcatacagtcctcgatttggagccagccctcggaaagcgggggttctcccggattgacatcgtgaaaattgctgcccatgacggcggagcccaggcccttcacgcagtgctcgacttgggccctacactccgcgagtgcggattttcccaggcaacaatcgccaagatcgctgggaacgggggaggcgcccaggcactccaaatggtcttggatctggggcctgccctgggcaaacgcgggtttagtcaggccacaattgcaaaaattgccggaaacaacgggggcgcacaggctctccagactgtgttggacttggagcccgccctgtgcgagaggggcttctcacaggccactatcgcaaaaatggctggcaatggagggggagcccaagccctgcaaaccgtcctggacctcgaacccgccctcagaaagcgggattttcggcaggccgacatcattaagattgccgggaacaacggcggcgctcaggcacttcaggccgtgattgagcatggacccacactccggcagcacggcttcaaccttgccgacattgtcaaaatggctggaaacaatggaggcgctcaagcactgcaagcagtgctcgacctgaagccagtgctggacgagcacgggttttctcagcccgacatcgtcaagatggctgggaacaacgggggagcacaagccctccaggctgtcctctctttggggcccgctctgagagagagaggattctcacagccagacatcgtgaagatcgccggccacgatggcggggcacaggccctgcaagccgtgctggacctggaactcaccttggtcgagcatggcttcagtcagcctgacatcgtgaggatcaccgggaacggagggggcgcacaagctcttcaggccgtgctcgctctggagttgactctgcgcgagaggggatttagccaaccagatattgtgaagattgccggacacgacggaggggctcaggcacttcaagctgtgctggatcttgagttgacttttagggagcggggctttagccaggcagacattgtgaaaattgccgggaacaacggaggaactcaagccttgcatgctgtgttggatttggaaagaatgctgggggagaggggcttctctcgggcagatattgtcaacgtggctggaaataacggaggagcacaggctttgaaggccgtcctggagcatgaggctacactgaatgagagggggttcagccgggccgatattgtcaagattgctggcaacaacggcggggcccaagccctgaaggcagtgttggaacatgaggcaacacttgatgaaagaggattcagcagagctgacattgtgaggattgctgggaacgggggaggagcccaggctcttaaggcagtccttgagcatggcccaaccctcaacgagagagggttcaacctgactgatattgtcgagatggcagctcatgatggcggcgcccaggccctcaaggctgtcttggagcacggccccacattgaggcagcggggcctgtcacttatcgacatcgtggagatcgcatctaacggaggcggcgcacaggctctgaaggctgtgttgaagtacggcccagtgctcatgcaggcagggagaagcaatgaggaaatcgtccatgtggccgctagaaggggcggagccggcaggattcggaaaatggtggcccctctcctggagcggcagggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 254 - DNA, 1284 bp, artificial sequence
  Description of artificial sequence: synthetic polynucleotide
gaaggatattggcatgccctagggtgaaaattcacactacgacactcggggggtgggtcccctccgagttctcgtccgcgggtgcctccacccagacctgaggggtgtcgggaagacccccgcctaccgagtcagggcgggattaagacctccggcgctggaaacgcgtagggcggggcccagacctggatccagctagccgggcggtgtggggtgcgcatgcgcaatgtccgcttcggctctaggaccgcgcgggcgacagcagggccgcggtgcagtgtccgacccgagagttgcggcctgagtcaccggccccgccctccggagccggacgctgcgggaggcccgggagcggcagtggaaccgactcccagaactccggacgtgtgcggcggtaagcgcccggcccgtaccccctccgcaccccgcaactccgactttggcggcccccagacccggcgaaaccgtgaagtctcggcctcaggagccccccagatccatggtctcagattcgaaccctcagacctgttcgatctccttttatgccgtcccggggacccttctccaccctctgtctcatgatccaaaatacaggcccataggtttcagagataccctgtgaattcttccttggggtgtcctgaaccgcgatcgtagatctgtgcccccagttccagcggggaaccccattgtccgggaacccagagctcacagccattaaggcgcgccggaccgcggccgcaattcgatcttagacccgagcccacagagccagaggtgacactggaatcctgccgctgggaatacctaaattctcaagcccacatttgggatttcctaaaccccgccctggggccctttaggccgtggatgtttgctccgcgcccatgacctgccaaggacctctacattcaggctgggctctggatctcacattctagcgcccagacatgtcgggaacgccttacgccaacttggggtccccaccaagagaacccccaccagatctgcaccctccccttcacgcgtgcacccagtccaggctccctcaagccccacgggtgccttttagacctgaggaggttgcaaacctgatcccccatacctgccccacccatccgcggacaacccgccctcgcaaactcagacccccacccggaggcttcagattcctcccaggtccagctgccggaaatgcgtgtttgaagggagggtgtgggctcaggggcgaagcacccactggtccccttttttccccccagcagtgagtcgcagccatgttcc

SEQ ID NO: 255 - DNA, 22 bp, artificial sequence
  Description of artificial sequence: synthetic polynucleotide
aattgcggccgcggtccggcgc

SEQ ID NO: 256 - DNA, 22 bp, artificial sequence
  Description of artificial sequence: synthetic polynucleotide
aaaaaggccggtagcccatacc

SEQ ID NO: 257 - DNA, 31 bp, artificial sequence
  Description of artificial sequence: synthetic polynucleotide
gccgccgccgcccttcaagaacgagttaacc

SEQ ID NO: 258 - DNA, 22 bp, artificial sequence
  Description of artificial sequence: synthetic polynucleotide
ttaaggcgcgccggaccgcggc

SEQ ID NO: 259 - protein, 37 aa, artificial sequence
  Description of artificial sequence: synthetic polypeptide
PDPALAALSNEEIVHVAARRGGAGRIRKMVAPLLERQ

SEQ ID NO: 260 - protein, 55 aa, artificial sequence
  Description of artificial sequence: synthetic polypeptide
SNEEIVHVAARRGGAGRIRKMVAPLLERQPDPALAALTNDHLVALACLGGRPALD

SEQ ID NO: 261 - protein, 52 aa, artificial sequence
  Description of artificial sequence: synthetic polypeptide
SNEEIVHVAARRGGAGRIRKMVAPLLERQHAPALIKRTNRRIPERTSHRVAD

SEQ ID NO: 262 - DNA, 163 bp, artificial sequence
  Description of artificial sequence: synthetic polynucleotide
cccgggggatcaggtcacgtgcgtctcggagacccgatccagccttggcagctctgagcaacgaggaaatcgtgcacgtcgccgccaggcgcgggggagccggcagaattaggaagatggtggcccctctccttgagcggcagggcagatctggctcggatcc

SEQ ID NO: 263 - DNA, 217 bp, artificial sequence
  Description of artificial sequence: synthetic polynucleotide
cccgggggatcaggtcacgtgcgtctcggagaagcaacgaggaaatcgtgcacgtcgccgccaggcgcgggggagccggcagaattaggaagatggtggcccctctccttgagcggcagccagaccccgctttggctgccctgacaaatgatcatctggtggcactggcctgcctcggcgggcggcccgccctggatggcagatctggctcggatcc

SEQ ID NO: 264 - DNA, 208 bp, artificial sequence
  Description of artificial sequence: synthetic polynucleotide
cccgggggatcaggtcacgtgcgtctcggagaagcaacgaggaaatcgtgcacgtcgccgccaggcgcgggggagccggcagaattaggaagatggtggcccctctccttgagcggcagcatgcacccgctctgattaaaaggacaaatcggagaatcccagagcggacctcccacagggtggccgatggcagatctggctcggatcc

SEQ ID NO: 265 - DNA, 1110 bp, artificial sequence
  Description of artificial sequence: synthetic polynucleotide
atgggcgatcctaaaaagaaacgtaaggtcatcgattacccatacgatgttccagattacgctatcgatatcgcctcaaccgccttcgtggaccaggataagcaaatggccaaccgcttgaacctgagtcccctggagaggtctaagattgagaagcagtacggcggggccacaactctggcctttatctccaacaagcagaacgagctggcccagatccttagccgggcagacatcttgaagattgcctcctatgattgtgctgcacacgccctccaggctgtcctcgattgcgggccaatgctggggaagagaggattctccggagacgcccgggggatcaggtcacgtgcgtctcggagacccgatccagccttggcagctctgagcaacgaggaaatcgtgcacgtcgccgccaggcgcgggggagccggcagaattaggaagatggtggcccctctccttgagcggcagggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 266 - DNA, 1164 bp, artificial sequence
  Description of artificial sequence: synthetic polynucleotide
atgggcgatcctaaaaagaaacgtaaggtcatcgattacccatacgatgttccagattacgctatcgatatcgcctcaaccgccttcgtggaccaggataagcaaatggccaaccgcttgaacctgagtcccctggagaggtctaagattgagaagcagtacggcggggccacaactctggcctttatctccaacaagcagaacgagctggcccagatccttagccgggcagacatcttgaagattgcctcctatgattgtgctgcacacgccctccaggctgtcctcgattgcgggccaatgctggggaagagaggattctccggagacgcccgggggatcaggtcacgtgcgtctcggagaagcaacgaggaaatcgtgcacgtcgccgccaggcgcgggggagccggcagaattaggaagatggtggcccctctccttgagcggcagccagaccccgctttggctgccctgacaaatgatcatctggtggcactggcctgcctcggcgggcggcccgccctggatggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 267 - DNA, 1155 bp, artificial sequence
  Description of artificial sequence: synthetic polynucleotide
atgggcgatcctaaaaagaaacgtaaggtcatcgattacccatacgatgttccagattacgctatcgatatcgcctcaaccgccttcgtggaccaggataagcaaatggccaaccgcttgaacctgagtcccctggagaggtctaagattgagaagcagtacggcggggccacaactctggcctttatctccaacaagcagaacgagctggcccagatccttagccgggcagacatcttgaagattgcctcctatgattgtgctgcacacgccctccaggctgtcctcgattgcgggccaatgctggggaagagaggattctccggagacgcccgggggatcaggtcacgtgcgtctcggagaagcaacgaggaaatcgtgcacgtcgccgccaggcgcgggggagccggcagaattaggaagatggtggcccctctccttgagcggcagcatgcacccgctctgattaaaaggacaaatcggagaatcccagagcggacctcccacagggtggccgatggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 268 - DNA, 2850 bp, artificial sequence
  Description of artificial sequence: synthetic polynucleotide
atgggcgatcctaaaaagaaacgtaaggtcatcgattacccatacgatgttccagattacgctatcgatatcgcctcaaccgccttcgtggaccaggataagcaaatggccaaccgcttgaacctgagtcccctggagaggtctaagattgagaagcagtacggcggggccacaactctggcctttatctccaacaagcagaacgagctggcccagatccttagccgggcagacatcttgaagattgcctcctatgattgtgctgcacacgccctccaggctgtcctcgattgcgggccaatgctggggaagagaggattctcccagtcagatatagtcaagatagcaggacatgatggtggcgctcaggcgttgcaagcggttctcgacctggagagcatgctgggcaagaggggcttttcacgcgacgacattgctaagatggctgggaacggcggcggggcccagacacttcaggcagtactggacctggagtcagcttttcgagagcgcggcttctcccaggcagacatagtgaaaatcgcaggcaacatcggaggcgcacaagccctgtacagtgtgctggacgtggagccaactctggggaagcgggggttttctagagcagatattgtcaagattgcagggaacggtggcggtgcgcaagccctgcacactgtgctggatcttgaacctgcgcttggtaagagaggattctctcgcatcgacatcgtaaagattgcggccaacattggcggggctcaggctctccacgccgtactggacttgggccccacgctccgagagtgtgggttcagccaggccaccatcgctaagatcgccggaaacatcggcggggcacaggcactccagatggtgcttgatctgggcccggccctgggcaaacgcgggttctcccaagctacgattgccaagatcgcaggaaatatcggcggagcgcaggctcttcagaccgtgctggaccttgagcctgccttgtgcgagcgcgggtttagtcaggccacaattgccaaaatggctggccacgatggaggtgcccaagctctccagactgtgcttgacctggaacccgccctccgaaaaagggattttcggcaggccgacatcatcaaaattgccggccacgacggtggagcgcaagccttgcaagcagttatcgaacacgggccaaccctgcggcagcatggctttaacctcgccgacatcgtgaagatggccggaaatggaggtggcgcacaggccctccaggccgtcttggatctgaagccagttcttgatgagcacggatttagccagcctgacattgtgaaaatggccgggaatatcggtggagcacaagcactccaggctgtcctgagtctgggtccagctctgcgggaacggggcttctctcaacctgacatagtcaaaatcgctggtaatattggcggtgctcaggcattgcaggccgttctcgatctggagctgaccctcgtggaacacgggttttcccaggccgatattgtgaagatagccggacacgatggggggacacaggcgctgcatgccgtcctggatctggagaggatgctgggcgagagagggttctccagagctgacatcgtcaacgtcgccgggcatgatgggggagcacaggctttgaaggctgtactggaacatgaggctaccctgaatgagaggggattcagccgggctgatattgttaagatcgctggacatgacggaggcgctcaagctctcaaagccgtgctcgaacacgaggcaactctggatgagcggggcttcagcagggcagacatcgttaatgttgccggaaacggtgggggtgcccaggccctcaaagcagtcctggaacacgaagccacactcaacgagcgaggattcaatttgaccgacattgtggaaatggcagcccacgatggcggcgcccaggcgttgaaagccgtgttggaacatggccccacactcaggcagagagggctgtctcttatcgacatagtggaaattgcaggcaatggcgggggagcccaggctctgaaagcggtgctgaagtatggacccgtgcttatgcaggccgggagacccgatccagccttggcagctctgagcaacgaggaaatcgtgcacgtcgccgccaggcgcgggggagccggcagaattaggaagatggtggcccctctccttgagcggcagggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 269 - DNA, 2904 bp, artificial sequence
  Description of artificial sequence: synthetic polynucleotide
atgggcgatcctaaaaagaaacgtaaggtcatcgattacccatacgatgttccagattacgctatcgatatcgcctcaaccgccttcgtggaccaggataagcaaatggccaaccgcttgaacctgagtcccctggagaggtctaagattgagaagcagtacggcggggccacaactctggcctttatctccaacaagcagaacgagctggcccagatccttagccgggcagacatcttgaagattgcctcctatgattgtgctgcacacgccctccaggctgtcctcgattgcgggccaatgctggggaagagaggattctcccagtcagatatagtcaagatagcaggacatgatggtggcgctcaggcgttgcaagcggttctcgacctggagagcatgctgggcaagaggggcttttcacgcgacgacattgctaagatggctgggaacggcggcggggcccagacacttcaggcagtactggacctggagtcagcttttcgagagcgcggcttctcccaggcagacatagtgaaaatcgcaggcaacatcggaggcgcacaagccctgtacagtgtgctggacgtggagccaactctggggaagcgggggttttctagagcagatattgtcaagattgcagggaacggtggcggtgcgcaagccctgcacactgtgctggatcttgaacctgcgcttggtaagagaggattctctcgcatcgacatcgtaaagattgcggccaacattggcggggctcaggctctccacgccgtactggacttgggccccacgctccgagagtgtgggttcagccaggccaccatcgctaagatcgccggaaacatcggcggggcacaggcactccagatggtgcttgatctgggcccggccctgggcaaacgcgggttctcccaagctacgattgccaagatcgcaggaaatatcggcggagcgcaggctcttcagaccgtgctggaccttgagcctgccttgtgcgagcgcgggtttagtcaggccacaattgccaaaatggctggccacgatggaggtgcccaagctctccagactgtgcttgacctggaacccgccctccgaaaaagggattttcggcaggccgacatcatcaaaattgccggccacgacggtggagcgcaagccttgcaagcagttatcgaacacgggccaaccctgcggcagcatggctttaacctcgccgacatcgtgaagatggccggaaatggaggtggcgcacaggccctccaggccgtcttggatctgaagccagttcttgatgagcacggatttagccagcctgacattgtgaaaatggccgggaatatcggtggagcacaagcactccaggctgtcctgagtctgggtccagctctgcgggaacggggcttctctcaacctgacatagtcaaaatcgctggtaatattggcggtgctcaggcattgcaggccgttctcgatctggagctgaccctcgtggaacacgggttttcccaggccgatattgtgaagatagccggacacgatggggggacacaggcgctgcatgccgtcctggatctggagaggatgctgggcgagagagggttctccagagctgacatcgtcaacgtcgccgggcatgatgggggagcacaggctttgaaggctgtactggaacatgaggctaccctgaatgagaggggattcagccgggctgatattgttaagatcgctggacatgacggaggcgctcaagctctcaaagccgtgctcgaacacgaggcaactctggatgagcggggcttcagcagggcagacatcgttaatgttgccggaaacggtgggggtgcccaggccctcaaagcagtcctggaacacgaagccacactcaacgagcgaggattcaatttgaccgacattgtggaaatggcagcccacgatggcggcgcccaggcgttgaaagccgtgttggaacatggccccacactcaggcagagagggctgtctcttatcgacatagtggaaattgcaggcaatggcgggggagcccaggctctgaaagcggtgctgaagtatggacccgtgcttatgcaggccgggagaagcaacgaggaaatcgtgcacgtcgccgccaggcgcgggggagccggcagaattaggaagatggtggcccctctccttgagcggcagccagaccccgctttggctgccctgacaaatgatcatctggtggcactggcctgcctcggcgggcggcccgccctggatggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 270 - DNA, 2895 bp, artificial sequence
  Description of artificial sequence: synthetic polynucleotide
atgggcgatcctaaaaagaaacgtaaggtcatcgattacccatacgatgttccagattacgctatcgatatcgcctcaaccgccttcgtggaccaggataagcaaatggccaaccgcttgaacctgagtcccctggagaggtctaagattgagaagcagtacggcggggccacaactctggcctttatctccaacaagcagaacgagctggcccagatccttagccgggcagacatcttgaagattgcctcctatgattgtgctgcacacgccctccaggctgtcctcgattgcgggccaatgctggggaagagaggattctcccagtcagatatagtcaagatagcaggacatgatggtggcgctcaggcgttgcaagcggttctcgacctggagagcatgctgggcaagaggggcttttcacgcgacgacattgctaagatggctgggaacggcggcggggcccagacacttcaggcagtactggacctggagtcagcttttcgagagcgcggcttctcccaggcagacatagtgaaaatcgcaggcaacatcggaggcgcacaagccctgtacagtgtgctggacgtggagccaactctggggaagcgggggttttctagagcagatattgtcaagattgcagggaacggtggcggtgcgcaagccctgcacactgtgctggatcttgaacctgcgcttggtaagagaggattctctcgcatcgacatcgtaaagattgcggccaacattggcggggctcaggctctccacgccgtactggacttgggccccacgctccgagagtgtgggttcagccaggccaccatcgctaagatcgccggaaacatcggcggggcacaggcactccagatggtgcttgatctgggcccggccctgggcaaacgcgggttctcccaagctacgattgccaagatcgcaggaaatatcggcggagcgcaggctcttcagaccgtgctggaccttgagcctgccttgtgcgagcgcgggtttagtcaggccacaattgccaaaatggctggccacgatggaggtgcccaagctctccagactgtgcttgacctggaacccgccctccgaaaaagggattttcggcaggccgacatcatcaaaattgccggccacgacggtggagcgcaagccttgcaagcagttatcgaacacgggccaaccctgcggcagcatggctttaacctcgccgacatcgtgaagatggccggaaatggaggtggcgcacaggccctccaggccgtcttggatctgaagccagttcttgatgagcacggatttagccagcctgacattgtgaaaatggccgggaatatcggtggagcacaagcactccaggctgtcctgagtctgggtccagctctgcgggaacggggcttctctcaacctgacatagtcaaaatcgctggtaatattggcggtgctcaggcattgcaggccgttctcgatctggagctgaccctcgtggaacacgggttttcccaggccgatattgtgaagatagccggacacgatggggggacacaggcgctgcatgccgtcctggatctggagaggatgctgggcgagagagggttctccagagctgacatcgtcaacgtcgccgggcatgatgggggagcacaggctttgaaggctgtactggaacatgaggctaccctgaatgagaggggattcagccgggctgatattgttaagatcgctggacatgacggaggcgctcaagctctcaaagccgtgctcgaacacgaggcaactctggatgagcggggcttcagcagggcagacatcgttaatgttgccggaaacggtgggggtgcccaggccctcaaagcagtcctggaacacgaagccacactcaacgagcgaggattcaatttgaccgacattgtggaaatggcagcccacgatggcggcgcccaggcgttgaaagccgtgttggaacatggccccacactcaggcagagagggctgtctcttatcgacatagtggaaattgcaggcaatggcgggggagcccaggctctgaaagcggtgctgaagtatggacccgtgcttatgcaggccgggagaagcaacgaggaaatcgtgcacgtcgccgccaggcgcgggggagccggcagaattaggaagatggtggcccctctccttgagcggcagcatgcacccgctctgattaaaaggacaaatcggagaatcccagagcggacctcccacagggtggccgatggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 271 - protein, 39 aa, artificial sequence
  Description of artificial sequence: synthetic polypeptide
IHKKFSSIQMSNEEIVHVAARRGGAGRIRKMVAPLLERQ

SEQ ID NO: 272 - protein, 45 aa, artificial sequence
  Description of artificial sequence: synthetic polypeptide
QSLAEQLGLNESQIKISNEEIVHVAARRGGAGRIRKMVAPLLERQ

SEQ ID NO: 273 - DNA, 169 bp, artificial sequence
  Description of artificial sequence: synthetic polynucleotide
cccgggggatcaggtcacgtgcgtctcggagaattcataagaagttcagcagtatccagatgtccaacgaagagattgtgcacgtggccgctcggaggggaggcgccgggaggatcagaaaaatggtggcacccttgcttgagcgccaaggcagatctggctcggatcc

SEQ ID NO: 274 - DNA, 187 bp, artificial sequence
  Description of artificial sequence: synthetic polynucleotide
cccgggggatcaggtcacgtgcgtctcggagacagagtctcgccgagcagctggggctgaatgagagccagatcaagatttccaacgaagagattgtgcacgtggccgctcggaggggaggcgccgggaggatcagaaaaatggtggcacccttgcttgagcgccaaggcagatctggctcggatcc

SEQ ID NO: 275 - DNA, 1116 bp, artificial sequence
  Description of artificial sequence: synthetic polynucleotide
atgggcgatcctaaaaagaaacgtaaggtcatcgattacccatacgatgttccagattacgctatcgatatcgcctcaaccgccttcgtggaccaggataagcaaatggccaaccgcttgaacctgagtcccctggagaggtctaagattgagaagcagtacggcggggccacaactctggcctttatctccaacaagcagaacgagctggcccagatccttagccgggcagacatcttgaagattgcctcctatgattgtgctgcacacgccctccaggctgtcctcgattgcgggccaatgctggggaagagaggattctccggagacgcccgggggatcaggtcacgtgcgtctcggagaattcataagaagttcagcagtatccagatgtccaacgaagagattgtgcacgtggccgctcggaggggaggcgccgggaggatcagaaaaatggtggcacccttgcttgagcgccaaggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 276 - DNA, 1134 bp, artificial sequence
  Description of artificial sequence: synthetic polynucleotide
atgggcgatcctaaaaagaaacgtaaggtcatcgattacccatacgatgttccagattacgctatcgatatcgcctcaaccgccttcgtggaccaggataagcaaatggccaaccgcttgaacctgagtcccctggagaggtctaagattgagaagcagtacggcggggccacaactctggcctttatctccaacaagcagaacgagctggcccagatccttagccgggcagacatcttgaagattgcctcctatgattgtgctgcacacgccctccaggctgtcctcgattgcgggccaatgctggggaagagaggattctccggagacgcccgggggatcaggtcacgtgcgtctcggagacagagtctcgccgagcagctggggctgaatgagagccagatcaagatttccaacgaagagattgtgcacgtggccgctcggaggggaggcgccgggaggatcagaaaaatggtggcacccttgcttgagcgccaaggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 277 - DNA, 1134 bp, artificial sequence
  Description of artificial sequence: synthetic polynucleotide
atgggcgatcctaaaaagaaacgtaaggtcatcgataaggagaccgccgctgccaagttcgagagacagcacatggacagcatcgatatcgcctcaaccgccttcgtggaccaggataagcaaatggccaaccgcttgaacctgagtcccctggagaggtctaagattgagaagcagtacggcggggccacaactctggcctttatctccaacaagcagaacgagctggcccagatccttagccgggcagacatcttgaagattgcctcctatgattgtgctgcacacgccctccaggctgtcctcgattgcgggccaatgctggggaagagaggattctccggagacgcccgggggatcaggtcacgtgcgtctcggagaattcataagaagttcagcagtatccagatgtccaacgaagagattgtgcacgtggccgctcggaggggaggcgccgggaggatcagaaaaatggtggcacccttgcttgagcgccaaggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 278 - DNA, 1152 bp, artificial sequence
  Description of artificial sequence: synthetic polynucleotide
atgggcgatcctaaaaagaaacgtaaggtcatcgataaggagaccgccgctgccaagttcgagagacagcacatggacagcatcgatatcgcctcaaccgccttcgtggaccaggataagcaaatggccaaccgcttgaacctgagtcccctggagaggtctaagattgagaagcagtacggcggggccacaactctggcctttatctccaacaagcagaacgagctggcccagatccttagccgggcagacatcttgaagattgcctcctatgattgtgctgcacacgccctccaggctgtcctcgattgcgggccaatgctggggaagagaggattctccggagacgcccgggggatcaggtcacgtgcgtctcggagacagagtctcgccgagcagctggggctgaatgagagccagatcaagatttccaacgaagagattgtgcacgtggccgctcggaggggaggcgccgggaggatcagaaaaatggtggcacccttgcttgagcgccaaggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 279 - DNA, 1605 bp, artificial sequence
  Description of artificial sequence: synthetic polynucleotide
accgcgtctctctcccagagtgatattgtcaaaattgcaggacatgacggaggagcccaagctctgcaagccgtgcttgacctggagagcatgttgggcaaaagaggcttttccagggacgatattgccaaaatggccgggaacggaggaggcgctcagacattgcaggctgtcctcgacttggagagcgcttttagggagcggggcttctcccaggccgacattgtgaaaattgccgggaacaacgggggagcccaggcactgtactccgtcctcgacgtggaacctacccttggaaagaggggctttagccgggctgatattgtgaagatcgcaggaaacgggggcggcgctcaagcactgcataccgtgctcgatctggagcccgccctcggaaaaagagggttctctagaatcgacatcgtgaaaatcgccgccaacaacggaggcgcccaggccctgcacgccgtgctggatttggggccaacccttcgcgaatgcggcttttcacaggctaccatcgcaaagatcgctgggaataatggcggggcccaggctttgcagatggtcctggacttgggcccagccctgggaaagagaggcttcagccaggccactattgccaagatcgccggcaacaacggcggcgcacaggctctccagacagtgttggacctcgaacccgcactttgcgagagggggttttcccaggccaccatcgccaagatggctggccacgatggcggagcacaagccctgcaaactgtgctcgatttggagccagccctgcggaagagagacttccggcaggctgacattattaagattgcaggcaatggagggggagcccaagcacttcaggcagtcattgaacatggacctacattgcgccagcatggattcaacctcgccgacattgtcaagatggctggccatgacgggggcgcccaggccctgcaagccgtcctggatctgaagcctgtgttggacgagcacggcttcagccagccagacattgtgaagatggccggaaataacggcggggcacaggctcttcaggccgtgctttccttggggcccgctctccgggagcggggctttagccagcctgatattgtgaaaatcgcaggcaacaacggcggagcacaggccctccaggcagtgctggatctcgaactcaccttggtggagcatgggttcagtcaggccgatattgtcaaaattgctggaaacaatggcggaacccaagctctccacgctgtgctcgacctggaaaggatgctcggggagagagggtttagcagggctgacatcgtgaacgtggccggcaacggaggaggggcccaagccctgaaggctgtgctggagcacgaagccactctgaacgagcgcgggttcaacctgaccgacatcgtggagatggccgcccacgacggaggcgctcaggcactgaaggccgtcttggagcacgggcctacactcagacagcggggcctgtccttgattgacattgtcgagattgcaggcaatgggggaggagcccaggctctcaaggctgtgttgaagtacggccccgtcctcatgcaggccgggagaggagacgcc

SEQ ID NO: 280 - DNA, 2658 bp, artificial sequence
  Description of artificial sequence: synthetic polynucleotide
atgggcgatcctaaaaagaaacgtaaggtcatcgattacccatacgatgttccagattacgctatcgatatcgcctcaaccgccttcgtggaccaggataagcaaatggccaaccgcttgaacctgagtcccctggagaggtctaagattgagaagcagtacggcggggccacaactctggcctttatctccaacaagcagaacgagctggcccagatccttagccgggcagacatcttgaagattgcctcctatgattgtgctgcacacgccctccaggctgtcctcgattgcgggccaatgctggggaagagaggattctcccagagtgatattgtcaaaattgcaggacatgacggaggagcccaagctctgcaagccgtgcttgacctggagagcatgttgggcaaaagaggcttttccagggacgatattgccaaaatggccgggcacgatggaggcgctcagacattgcaggctgtcctcgacttggagagcgcttttagggagcggggcttctcccaggccgacattgtgaaaattgccgggaacaacgggggagcccaggcactgtactccgtcctcgacgtggaacctacccttggaaagaggggctttagccgggctgatattgtgaagatcgcaggaaacaacggcggcgctcaagcactgcataccgtgctcgatctggagcccgccctcggaaaaagagggttctctagaatcgacatcgtgaaaatcgccgccaacaacggaggcgcccaggccctgcacgccgtgctggatttggggccaacccttcgcgaatgcggcttttcacaggctaccatcgcaaagatcgctgggaatatcggcggggcccaggctttgcagatggtcctggacttgggcccagccctgggaaagagaggcttcagccaggccactattgccaagatcgccggcaacattggcggcgcacaggctctccagacagtgttggacctcgaacccgcactttgcgagagggggttttcccaggccaccatcgccaagatggctggccacgatggcggagcacaagccctgcaaactgtgctcgatttggagccagccctgcggaagagagacttccggcaggctgacattattaagattgcaggccatgatgggggagcccaagcacttcaggcagtcattgaacatggacctacattgcgccagcatggattcaacctcgccgacattgtcaagatggctggccatgacgggggcgcccaggccctgcaagccgtcctggatctgaagcctgtgttggacgagcacggcttcagccagccagacattgtgaagatggccggaaatattggcggggcacaggctcttcaggccgtgctttccttggggcccgctctccgggagcggggctttagccagcctgatattgtgaaaatcgcaggcaacaacggcggagcacaggccctccaggcagtgctggatctcgaactcaccttggtggagcatgggttcagtcaggccgatattgtcaaaattgctggaaacatcggcggaacccaagctctccacgctgtgctcgacctggaaaggatgctcggggagagagggtttagcagggctgacatcgtgaacgtggccggcaacaatggaggggcccaagccctgaaggctgtgctggagcacgaagccactctgaacgagcgcgggttcaacctgaccgacatcgtggagatggccgcccacgacggaggcgctcaggcactgaaggccgtcttggagcacgggcctacactcagacagcggggcctgtccttgattgacattgtcgagattgcaggcaatgggggaggagcccaggctctcaaggctgtgttgaagtacggccccgtcctcatgcaggccgggagaattcataagaagttcagcagtatccagatgtccaacgaagagattgtgcacgtggccgctcggaggggaggcgccgggaggatcagaaaaatggtggcacccttgcttgagcgccaaggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 281 - DNA, 2676 bp, artificial sequence
  Description of artificial sequence: synthetic polynucleotide
atgggcgatcctaaaaagaaacgtaaggtcatcgattacccatacgatgttccagattacgctatcgatatcgcctcaaccgccttcgtggaccaggataagcaaatggccaaccgcttgaacctgagtcccctggagaggtctaagattgagaagcagtacggcggggccacaactctggcctttatctccaacaagcagaacgagctggcccagatccttagccgggcagacatcttgaagattgcctcctatgattgtgctgcacacgccctccaggctgtcctcgattgcgggccaatgctggggaagagaggattctcccagagtgatattgtcaaaattgcaggacatgacggaggagcccaagctctgcaagccgtgcttgacctggagagcatgttgggcaaaagaggcttttccagggacgatattgccaaaatggccgggcacgatggaggcgctcagacattgcaggctgtcctcgacttggagagcgcttttagggagcggggcttctcccaggccgacattgtgaaaattgccgggaacaacgggggagcccaggcactgtactccgtcctcgacgtggaacctacccttggaaagaggggctttagccgggctgatattgtgaagatcgcaggaaacaacggcggcgctcaagcactgcataccgtgctcgatctggagcccgccctcggaaaaagagggttctctagaatcgacatcgtgaaaatcgccgccaacaacggaggcgcccaggccctgcacgccgtgctggatttggggccaacccttcgcgaatgcggcttttcacaggctaccatcgcaaagatcgctgggaatatcggcggggcccaggctttgcagatggtcctggacttgggcccagccctgggaaagagaggcttcagccaggccactattgccaagatcgccggcaacattggcggcgcacaggctctccagacagtgttggacctcgaacccgcactttgcgagagggggttttcccaggccaccatcgccaagatggctggccacgatggcggagcacaagccctgcaaactgtgctcgatttggagccagccctgcggaagagagacttccggcaggctgacattattaagattgcaggccatgatgggggagcccaagcacttcaggcagtcattgaacatggacctacattgcgccagcatggattcaacctcgccgacattgtcaagatggctggccatgacgggggcgcccaggccctgcaagccgtcctggatctgaagcctgtgttggacgagcacggcttcagccagccagacattgtgaagatggccggaaatattggcggggcacaggctcttcaggccgtgctttccttggggcccgctctccgggagcggggctttagccagcctgatattgtgaaaatcgcaggcaacaacggcggagcacaggccctccaggcagtgctggatctcgaactcaccttggtggagcatgggttcagtcaggccgatattgtcaaaattgctggaaacatcggcggaacccaagctctccacgctgtgctcgacctggaaaggatgctcggggagagagggtttagcagggctgacatcgtgaacgtggccggcaacaatggaggggcccaagccctgaaggctgtgctggagcacgaagccactctgaacgagcgcgggttcaacctgaccgacatcgtggagatggccgcccacgacggaggcgctcaggcactgaaggccgtcttggagcacgggcctacactcagacagcggggcctgtccttgattgacattgtcgagattgcaggcaatgggggaggagcccaggctctcaaggctgtgttgaagtacggccccgtcctcatgcaggccgggagacagagtctcgccgagcagctggggctgaatgagagccagatcaagatttccaacgaagagattgtgcacgtggccgctcggaggggaggcgccgggaggatcagaaaaatggtggcacccttgcttgagcgccaaggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 282 - DNA, 2676 bp, artificial sequence
  Description of artificial sequence: synthetic polynucleotide
atgggcgatcctaaaaagaaacgtaaggtcatcgataaggagaccgccgctgccaagttcgagagacagcacatggacagcatcgatatcgcctcaaccgccttcgtggaccaggataagcaaatggccaaccgcttgaacctgagtcccctggagaggtctaagattgagaagcagtacggcggggccacaactctggcctttatctccaacaagcagaacgagctggcccagatccttagccgggcagacatcttgaagattgcctcctatgattgtgctgcacacgccctccaggctgtcctcgattgcgggccaatgctggggaagagaggattctcccagagtgatattgtcaaaattgcaggacatgacggaggagcccaagctctgcaagccgtgcttgacctggagagcatgttgggcaaaagaggcttttccagggacgatattgccaaaatggccgggaacggaggaggcgctcagacattgcaggctgtcctcgacttggagagcgcttttagggagcggggcttctcccaggccgacattgtgaaaattgccgggaacaacgggggagcccaggcactgtactccgtcctcgacgtggaacctacccttggaaagaggggctttagccgggctgatattgtgaagatcgcaggaaacgggggcggcgctcaagcactgcataccgtgctcgatctggagcccgccctcggaaaaagagggttctctagaatcgacatcgtgaaaatcgccgccaacaacggaggcgcccaggccctgcacgccgtgctggatttggggccaacccttcgcgaatgcggcttttcacaggctaccatcgcaaagatcgctgggaataatggcggggcccaggctttgcagatggtcctggacttgggcccagccctgggaaagagaggcttcagccaggccactattgccaagatcgccggcaacaacggcggcgcacaggctctccagacagtgttggacctcgaacccgcactttgcgagagggggttttcccaggccaccatcgccaagatggctggccacgatggcggagcacaagccctgcaaactgtgctcgatttggagccagccctgcggaagagagacttccggcaggctgacattattaagattgcaggcaatggagggggagcccaagcacttcaggcagtcattgaacatggacctacattgcgccagcatggattcaacctcgccgacattgtcaagatggctggccatgacgggggcgcccaggccctgcaagccgtcctggatctgaagcctgtgttggacgagcacggcttcagccagccagacattgtgaagatggccggaaataacggcggggcacaggctcttcaggccgtgctttccttggggcccgctctccgggagcggggctttagccagcctgatattgtgaaaatcgcaggcaacaacggcggagcacaggccctccaggcagtgctggatctcgaactcaccttggtggagcatgggttcagtcaggccgatattgtcaaaattgctggaaacaatggcggaacccaagctctccacgctgtgctcgacctggaaaggatgctcggggagagagggtttagcagggctgacatcgtgaacgtggccggcaacggaggaggggcccaagccctgaaggctgtgctggagcacgaagccactctgaacgagcgcgggttcaacctgaccgacatcgtggagatggccgcccacgacggaggcgctcaggcactgaaggccgtcttggagcacgggcctacactcagacagcggggcctgtccttgattgacattgtcgagattgcaggcaatgggggaggagcccaggctctcaaggctgtgttgaagtacggccccgtcctcatgcaggccgggagaattcataagaagttcagcagtatccagatgtccaacgaagagattgtgcacgtggccgctcggaggggaggcgccgggaggatcagaaaaatggtggcacccttgcttgagcgccaaggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 283 - DNA, 2694 bp, artificial sequence
  Description of artificial sequence: synthetic polynucleotide
atgggcgatcctaaaaagaaacgtaaggtcatcgataaggagaccgccgctgccaagttcgagagacagcacatggacagcatcgatatcgcctcaaccgccttcgtggaccaggataagcaaatggccaaccgcttgaacctgagtcccctggagaggtctaagattgagaagcagtacggcggggccacaactctggcctttatctccaacaagcagaacgagctggcccagatccttagccgggcagacatcttgaagattgcctcctatgattgtgctgcacacgccctccaggctgtcctcgattgcgggccaatgctggggaagagaggattctcccagagtgatattgtcaaaattgcaggacatgacggaggagcccaagctctgcaagccgtgcttgacctggagagcatgttgggcaaaagaggcttttccagggacgatattgccaaaatggccgggaacggaggaggcgctcagacattgcaggctgtcctcgacttggagagcgcttttagggagcggggcttctcccaggccgacattgtgaaaattgccgggaacaacgggggagcccaggcactgtactccgtcctcgacgtggaacctacccttggaaagaggggctttagccgggctgatattgtgaagatcgcaggaaacgggggcggcgctcaagcactgcataccgtgctcgatctggagcccgccctcggaaaaagagggttctctagaatcgacatcgtgaaaatcgccgccaacaacggaggcgcccaggccctgcacgccgtgctggatttggggccaacccttcgcgaatgcggcttttcacaggctaccatcgcaaagatcgctgggaataatggcggggcccaggctttgcagatggtcctggacttgggcccagccctgggaaagagaggcttcagccaggccactattgccaagatcgccggcaacaacggcggcgcacaggctctccagacagtgttggacctcgaacccgcactttgcgagagggggttttcccaggccaccatcgccaagatggctggccacgatggcggagcacaagccctgcaaactgtgctcgatttggagccagccctgcggaagagagacttccggcaggctgacattattaagattgcaggcaatggagggggagcccaagcacttcaggcagtcattgaacatggacctacattgcgccagcatggattcaacctcgccgacattgtcaagatggctggccatgacgggggcgcccaggccctgcaagccgtcctggatctgaagcctgtgttggacgagcacggcttcagccagccagacattgtgaagatggccggaaataacggcggggcacaggctcttcaggccgtgctttccttggggcccgctctccgggagcggggctttagccagcctgatattgtgaaaatcgcaggcaacaacggcggagcacaggccctccaggcagtgctggatctcgaactcaccttggtggagcatgggttcagtcaggccgatattgtcaaaattgctggaaacaatggcggaacccaagctctccacgctgtgctcgacctggaaaggatgctcggggagagagggtttagcagggctgacatcgtgaacgtggccggcaacggaggaggggcccaagccctgaaggctgtgctggagcacgaagccactctgaacgagcgcgggttcaacctgaccgacatcgtggagatggccgcccacgacggaggcgctcaggcactgaaggccgtcttggagcacgggcctacactcagacagcggggcctgtccttgattgacattgtcgagattgcaggcaatgggggaggagcccaggctctcaaggctgtgttgaagtacggccccgtcctcatgcaggccgggagacagagtctcgccgagcagctggggctgaatgagagccagatcaagatttccaacgaagagattgtgcacgtggccgctcggaggggaggcgccgggaggatcagaaaaatggtggcacccttgcttgagcgccaaggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 284 - DNA, 49 bp, artificial sequence
  Description of artificial sequence: synthetic polynucleotide
tccgggaacccagagctcacagccacgatcttagacccgagcccacaga

SEQ ID NO: 285 - DNA, 1214 bp, artificial sequence
  Description of artificial sequence: synthetic polynucleotide
ggcgcgccactagcgctctcgaggtcacgcgccaagccgccaccatggcggaccgttccggacccaacagaggcgttaccaagcaactagttaaatccgaactggaagagaaaaagtccgagttgcgtcataaactgaagtacgttccacatgaatacattgaactgatcgagattgcccgtaacagcacccaggacagaatcctggaaatgaaagtgatggagtttttcatgaaagtgtacggctacagaggcaaacatttgggcggtagccgtaaaccggatggtgccatctacaccgttggcagcccgattgattacggcgtgatcgttgataccaaagcctactccggtggctacaacctgccgattggccaggctgacgaaatgcagagatacgtggaagagaaccagactcgtaacaagcatatcaacccgaacgaatggtggaaagtctacccgagttccgtgactgagttcaaatttctgtttgtgagcggccatttcaaaggcaactacaaagcccagctgaccagactgaaccatatcaccaactgcaacggtgccgtcttgagcgtggaagaactgttgattggtggcgaaatgatcaaggctggcaccctgactctggaggaagttagacgtaaattcaacaacggtgaaatcaactttggttcctccggcctgcagggatcaaccgccttcgtggaccaggataagcaaatggccaaccgcttgaacctgagtcccctggagaggtctaagattgagaagcagtacggcggggccacaactctggcctttatctccaacaagcagaacgagctggcccagatccttagccgggcagacatcttgaagattgcctcctatgattgtgctgcacacgccctccaggctgtcctcgattgcgggccaatgctggggaagagaggattctccggagacgcccgggggatcaggtcacgtgcgtctcggagaagcaacgaggaaatcgtgcacgtcgccgccaggcgcgggggagccggcagaattaggaagatggtggcccctctccttgagcggcagccagaccccgctttggctgccctgacaaatgatcatctggtggcactggcctgcctcggcgggcggcccgccctggatggcagatctggctcgcgggatcccggcgatcctaaaaagaaacgtaaggtcatcgcggccgactgataa

SEQ ID NO: 286 - DNA, 1170 bp, artificial sequence
  Description of artificial sequence: synthetic polynucleotide
atggcggaccgttccggacccaacagaggcgttaccaagcaactagttaaatccgaactggaagagaaaaagtccgagttgcgtcataaactgaagtacgttccacatgaatacattgaactgatcgagattgcccgtaacagcacccaggacagaatcctggaaatgaaagtgatggagtttttcatgaaagtgtacggctacagaggcaaacatttgggcggtagccgtaaaccggatggtgccatctacaccgttggcagcccgattgattacggcgtgatcgttgataccaaagcctactccggtggctacaacctgccgattggccaggctgacgaaatgcagagatacgtggaagagaaccagactcgtaacaagcatatcaacccgaacgaatggtggaaagtctacccgagttccgtgactgagttcaaatttctgtttgtgagcggccatttcaaaggcaactacaaagcccagctgaccagactgaaccatatcaccaactgcaacggtgccgtcttgagcgtggaagaactgttgattggtggcgaaatgatcaaggctggcaccctgactctggaggaagttagacgtaaattcaacaacggtgaaatcaactttggttcctccggcctgcagggatcaaccgccttcgtggaccaggataagcaaatggccaaccgcttgaacctgagtcccctggagaggtctaagattgagaagcagtacggcggggccacaactctggcctttatctccaacaagcagaacgagctggcccagatccttagccgggcagacatcttgaagattgcctcctatgattgtgctgcacacgccctccaggctgtcctcgattgcgggccaatgctggggaagagaggattctccggagacgcccgggggatcaggtcacgtgcgtctcggagaagcaacgaggaaatcgtgcacgtcgccgccaggcgcgggggagccggcagaattaggaagatggtggcccctctccttgagcggcagccagaccccgctttggctgccctgacaaatgatcatctggtggcactggcctgcctcggcgggcggcccgccctggatggcagatctggctcgcgggatcccggcgatcctaaaaagaaacgtaaggtcatcgcggccgactgataa

SEQ ID NO: 287 - DNA, 2910 bp, artificial sequence
  Description of artificial sequence: synthetic polynucleotide
atggcggaccgttccggacccaacagaggcgttaccaagcaactagttaaatccgaactggaagagaaaaagtccgagttgcgtcataaactgaagtacgttccacatgaatacattgaactgatcgagattgcccgtaacagcacccaggacagaatcctggaaatgaaagtgatggagtttttcatgaaagtgtacggctacagaggcaaacatttgggcggtagccgtaaaccggatggtgccatctacaccgttggcagcccgattgattacggcgtgatcgttgataccaaagcctactccggtggctacaacctgccgattggccaggctgacgaaatgcagagatacgtggaagagaaccagactcgtaacaagcatatcaacccgaacgaatggtggaaagtctacccgagttccgtgactgagttcaaatttctgtttgtgagcggccatttcaaaggcaactacaaagcccagctgaccagactgaaccatatcaccaactgcaacggtgccgtcttgagcgtggaagaactgttgattggtggcgaaatgatcaaggctggcaccctgactctggaggaagttagacgtaaattcaacaacggtgaaatcaactttggttcctccggcctgcagggatcaaccgccttcgtggaccaggataagcaaatggccaaccgcttgaacctgagtcccctggagaggtctaagattgagaagcagtacggcggggccacaactctggcctttatctccaacaagcagaacgagctggcccagatccttagccgggcagacatcttgaagattgcctcctatgattgtgctgcacacgccctccaggctgtcctcgattgcgggccaatgctggggaagagaggattctcccagtcagatatagtcaagatagcaggacatgatggtggcgctcaggcgttgcaagcggttctcgacctggagagcatgctgggcaagaggggcttttcacgcgacgacattgctaagatggctgggaacggcggcggggcccagacacttcaggcagtactggacctggagtcagcttttcgagagcgcggcttctcccaggcagacatagtgaaaatcgcaggcaacatcggaggcgcacaagccctgtacagtgtgctggacgtggagccaactctggggaagcgggggttttctagagcagatattgtcaagattgcagggaacggtggcggtgcgcaagccctgcacactgtgctggatcttgaacctgcgcttggtaagagaggattctctcgcatcgacatcgtaaagattgcggccaacattggcggggctcaggctctccacgccgtactggacttgggccccacgctccgagagtgtgggttcagccaggccaccatcgctaagatcgccggaaacatcggcggggcacaggcactccagatggtgcttgatctgggcccggccctgggcaaacgcgggttctcccaagctacgattgccaagatcgcaggaaatatcggcggagcgcaggctcttcagaccgtgctggaccttgagcctgccttgtgcgagcgcgggtttagtcaggccacaattgccaaaatggctggccacgatggaggtgcccaagctctccagactgtgcttgacctggaacccgccctccgaaaaagggattttcggcaggccgacatcatcaaaattgccggccacgacggtggagcgcaagccttgcaagcagttatcgaacacgggccaaccctgcggcagcatggctttaacctcgccgacatcgtgaagatggccggaaatggaggtggcgcacaggccctccaggccgtcttggatctgaagccagttcttgatgagcacggatttagccagcctgacattgtgaaaatggccgggaatatcggtggagcacaagcactccaggctgtcctgagtctgggtccagctctgcgggaacggggcttctctcaacctgacatagtcaaaatcgctggtaatattggcggtgctcaggcattgcaggccgttctcgatctggagctgaccctcgtggaacacgggttttcccaggccgatattgtgaagatagccggacacgatggggggacacaggcgctgcatgccgtcctggatctggagaggatgctgggcgagagagggttctccagagctgacatcgtcaacgtcgccgggcatgatgggggagcacaggctttgaaggctgtactggaacatgaggctaccctgaatgagaggggattcagccgggctgatattgttaagatcgctggacatgacggaggcgctcaagctctcaaagccgtgctcgaacacgaggcaactctggatgagcggggcttcagcagggcagacatcgttaatgttgccggaaacggtgggggtgcccaggccctcaaagcagtcctggaacacgaagccacactcaacgagcgaggattcaatttgaccgacattgtggaaatggcagcccacgatggcggcgcccaggcgttgaaagccgtgttggaacatggccccacactcaggcagagagggctgtctcttatcgacatagtggaaattgcaggcaatggcgggggagcccaggctctgaaagcggtgctgaagtatggacccgtgcttatgcaggccgggagaagcaacgaggaaatcgtgcacgtcgccgccaggcgcgggggagccggcagaattaggaagatggtggcccctctccttgagcggcagccagaccccgctttggctgccctgacaaatgatcatctggtggcactggcctgcctcggcgggcggcccgccctggatggcagatctggctcgcgggatcccggcgatcctaaaaagaaacgtaaggtcatcgcggccgactgataa

SEQ ID NO: 288 - DNA, 1086 bp, artificial sequence; identical to SEQ ID NO: 124
  Description of artificial sequence: synthetic polynucleotide

SEQ ID NO: 289 - DNA, 2628 bp, artificial sequence; identical to SEQ ID NO: 220
  Description of artificial sequence: synthetic polynucleotide

SEQ ID NO: 290 - DNA, 19 bp, artificial sequence
  Description of artificial sequence: synthetic polynucleotide
tatataaacctaaccctct

SEQ ID NO: 291 - DNA, 43 bp, artificial sequence
  Description of artificial sequence: synthetic polynucleotide
agagggttaggtttatataaggtatatataaacctaaccctct

SEQ ID NO: 292 - DNA, 44 bp, artificial sequence
  Description of artificial sequence: synthetic polynucleotide
agagggttaggtttatataaaggtatatataaacctaaccctct

SEQ ID NO: 293 - DNA, 45 bp, artificial sequence
  Description of artificial sequence: synthetic polynucleotide
agagggttaggtttatataaaggtactatataaacctaaccctct

SEQ ID NO: 294 - DNA, 46 bp, artificial sequence
  Description of artificial sequence: synthetic polynucleotide
agagggttaggtttatatagaaggtactatataaacctaaccctct

SEQ ID NO: 295 - DNA, 47 bp, artificial sequence
  Description of artificial sequence: synthetic polynucleotide
agagggttaggtttatatagaaggtacctatataaacctaaccctct

SEQ ID NO: 296 - DNA, 48 bp, artificial sequence
  Description of artificial sequence: synthetic polynucleotide
agagggttaggtttatatatgaaggtacctatataaacctaaccctct

SEQ ID NO: 297 - DNA, 49 bp, artificial sequence
  Description of artificial sequence: synthetic polynucleotide
agagggttaggtttatatatgaaggtaccttatataaacctaaccctct

SEQ ID NO: 298 - DNA, 50 bp, artificial sequence
  Description of artificial sequence: synthetic polynucleotide
agagggttaggtttatataatgaaggtaccttatataaacctaaccctct

SEQ ID NO: 299 - DNA, 51 bp, artificial sequence
  Description of artificial sequence: synthetic polynucleotide
agagggttaggtttatataatgaaggtacctttatataaacctaaccctct

SEQ ID NO: 300 - DNA, 52 bp, artificial sequence
  Description of artificial sequence: synthetic polynucleotide
agagggttaggtttatatacatgaaggtacctttatataaacctaaccctct

SEQ ID NO: 301 - DNA, 53 bp, artificial sequence
  Description of artificial sequence: synthetic polynucleotide
agagggttaggtttatatacatgaaggtaccttgtatataaacctaaccctct

SEQ ID NO: 302 - DNA, 54 bp, artificial sequence
  Description of artificial sequence: synthetic polynucleotide
agagggttaggtttatatagcatgaaggtaccttgtatataaacctaaccctct

SEQ ID NO: 303 - DNA, 55 bp, artificial sequence
  Description of artificial sequence: synthetic polynucleotide
agagggttaggtttatatagcatgaaggtaccttgttatataaacctaaccctct

SEQ ID NO: 304 - DNA, 56 bp, artificial sequence
  Description of artificial sequence: synthetic polynucleotide
agagggttaggtttatataagcatgaaggtaccttgttatataaacctaaccctct

SEQ ID NO: 305 - DNA, 57 bp, artificial sequence
  Description of artificial sequence: synthetic polynucleotide
agagggttaggtttatataagcatgaaggtaccttgtctatataaacctaaccctct

SEQ ID NO: 306 - DNA, 58 bp, artificial sequence
  Description of artificial sequence: synthetic polynucleotide
agagggttaggtttatatatagcatgaaggtaccttgtctatataaacctaaccctct

SEQ ID NO: 307 - DNA, 59 bp, artificial sequence
  Description of artificial sequence: synthetic polynucleotide
agagggttaggtttatatatagcatgaaggtaccttgtcgtatataaacctaaccctct

SEQ ID NO: 308 - DNA, 60 bp, artificial sequence
  Description of artificial sequence: synthetic polynucleotide
agagggttaggtttatatatagcatgaaggtaccttgtcgttatataaacctaaccctct

SEQ ID NO: 309 - DNA, 61 bp, artificial sequence
  Description of artificial sequence: synthetic polynucleotide
agagggttaggtttatatactagcatgaaggtaccttgtcgttatataaacctaaccctct

SEQ ID NO: 310 - DNA, 62 bp, artificial sequence
  Description of artificial sequence: synthetic polynucleotide
agagggttaggtttatatactagcatgaaggtaccttgtcgtttatataaacctaaccctct

SEQ ID NO: 311 - DNA, 63 bp, artificial sequence
  Description of artificial sequence: synthetic polynucleotide
agagggttaggtttatataactagcatgaaggtaccttgtcgtttatataaacctaaccctct

SEQ ID NO: 312 - DNA, 64 bp, artificial sequence
  Description of artificial sequence: synthetic polynucleotide
agagggttaggtttatataactagcatgaaggtaccttgtcgttgtatataaacctaaccctct

SEQ ID NO: 313 - DNA, 65 bp, artificial sequence
  Description of artificial sequence: synthetic polynucleotide
agagggttaggtttatatacactagcatgaaggtaccttgtcgttgtatataaacctaaccctct

SEQ ID NO: 314 - DNA, 66 bp, artificial sequence
  Description of artificial sequence: synthetic polynucleotide
agagggttaggtttatatacactagcatgaaggtaccttgtcgttgatatataaacctaaccctct

SEQ ID NO: 315 - DNA, 67 bp, artificial sequence
  Description of artificial sequence: synthetic polynucleotide
agagggttaggtttatataccactagcatgaaggtaccttgtcgttgatatataaacctaaccctct

SEQ ID NO: 316 - DNA, 68 bp, artificial sequence
  Description of artificial sequence: synthetic polynucleotide
agagggttaggtttatataccactagcatgaaggtaccttgtcgttgattatataaacctaaccctct

SEQ ID NO: 317 - DNA, 69 bp, artificial sequence
  Description of artificial sequence: synthetic polynucleotide
agagggttaggtttatataaccactagcatgaaggtaccttgtcgttgattatataaacctaaccctct

SEQ ID NO: 318 - DNA, 70 bp, artificial sequence
  Description of artificial sequence: synthetic polynucleotide
agagggttaggtttatataaccactagcatgaaggtaccttgtcgttgatttatataaacctaaccctct

SEQ ID NO: 319 - DNA, 71 bp, artificial sequence
  Description of artificial sequence: synthetic polynucleotide
agagggttaggtttatatagaccactagcatgaaggtaccttgtcgttgatttatataaacctaaccctct

SEQ ID NO: 320 - DNA, 72 bp, artificial sequence
  Description of artificial sequence: synthetic polynucleotide
agagggttaggtttatatagaccactagcatgaaggtaccttgtcgttgattctatataaacctaaccctct

SEQ ID NO: 321 - DNA, 73 bp, artificial sequence
  Description of artificial sequence: synthetic polynucleotide
agagggttaggtttatatatgaccactagcatgaaggtaccttgtcgttgattctatataaacctaaccctct

SEQ ID NO: 322 - DNA, 17 bp, artificial sequence
  Description of artificial sequence: synthetic polynucleotide
tgtttatggttacttat

SEQ ID NO: 323 - DNA, 41 bp, artificial sequence
  Description of artificial sequence: synthetic polynucleotide
tgtttatggttacttataggtatatataaacctaaccctct

SEQ ID NO: 324 - DNA, 42 bp, artificial sequence
  Description of artificial sequence: synthetic polynucleotide
tgtttatggttacttataaggtatatataaacctaaccctct

SEQ ID NO: 325 - DNA, 43 bp, artificial sequence
  Description of artificial sequence: synthetic polynucleotide
tgtttatggttacttataaggtactatataaacctaaccctct

SEQ ID NO: 326 - DNA, 44 bp, artificial sequence
  Description of artificial sequence: synthetic polynucleotide
tgtttatggttacttatgaaggtactatataaacctaaccctct

SEQ ID NO: 327 - DNA, 45 bp, artificial sequence
  Description of artificial sequence: synthetic polynucleotide
tgtttatggttacttatgaaggtacctatataaacctaaccctct

SEQ ID NO: 328 - DNA, 46 bp, artificial sequence
  Description of artificial sequence: synthetic polynucleotide
tgtttatggttacttattgaaggtacctatataaacctaaccctct

SEQ ID NO: 329 - DNA, 47 bp, artificial sequence
  Description of artificial sequence: synthetic polynucleotide
tgtttatggttacttattgaaggtaccttatataaacctaaccctct

SEQ ID NO: 330 - DNA, 48 bp, artificial sequence
  Description of artificial sequence: synthetic polynucleotide
tgtttatggttacttatatgaaggtaccttatataaacctaaccctct

SEQ ID NO: 331 - DNA, 49 bp, artificial sequence
  Description of artificial sequence: synthetic polynucleotide
tgtttatggttacttatatgaaggtacctttatataaacctaaccctct

SEQ ID NO: 332 - DNA, 50 bp, artificial sequence
  Description of artificial sequence: synthetic polynucleotide
tgtttatggttacttatcatgaaggtacctttatataaacctaaccctct

SEQ ID NO: 333 - DNA, 51 bp, artificial sequence
  Description of artificial sequence: synthetic polynucleotide
tgtttatggttacttattagcatgaaggtacctatataaacctaaccctct

SEQ ID NO: 334 - DNA, 52 bp, artificial sequence
  Description of artificial sequence: synthetic polynucleotide
tgtttatggttacttatgcatgaaggtaccttgtatataaacctaaccctct

SEQ ID NO: 335 - DNA, 53 bp, artificial sequence
  Description of artificial sequence: synthetic polynucleotide
tgtttatggttacttatgcatgaaggtaccttgttatataaacctaaccctct

SEQ ID NO: 336 - DNA, 54 bp, artificial sequence
  Description of artificial sequence: synthetic polynucleotide
tgtttatggttacttatagcatgaaggtaccttgttatataaacctaaccctct

SEQ ID NO: 337 - DNA, 55 bp, artificial sequence
  Description of artificial sequence: synthetic polynucleotide
tgtttatggttacttatagcatgaaggtaccttgtctatataaacctaaccctct

SEQ ID NO: 338 - DNA, 56 bp, artificial sequence
  Description of artificial sequence: synthetic polynucleotide
tgtttatggttacttattagcatgaaggtaccttgtctatataaacctaaccctct

SEQ ID NO: 339 - DNA, 57 bp, artificial sequence
  Description of artificial sequence: synthetic polynucleotide
tgtttatggttacttattagcatgaaggtaccttgtcgtatataaacctaaccctct

SEQ ID NO: 340 - DNA, 58 bp, artificial sequence
  Description of artificial sequence: synthetic polynucleotide
tgtttatggttacttattagcatgaaggtaccttgtcgttatataaacctaaccctct

SEQ ID NO: 341 - DNA, 59 bp, artificial sequence
  Description of artificial sequence: synthetic polynucleotide
tgtttatggttacttatctagcatgaaggtaccttgtcgttatataaacctaaccctct

SEQ ID NO: 342 - DNA, 60 bp, artificial sequence
  Description of artificial sequence: synthetic polynucleotide
tgtttatggttacttatctagcatgaaggtaccttgtcgtttatataaacctaaccctct

SEQ ID NO: 343 - DNA, 61 bp, artificial sequence
  Description of artificial sequence: synthetic polynucleotide
tgtttatggttacttatactagcatgaaggtaccttgtcgtttatataaacctaaccctct

SEQ ID NO: 344 - DNA, 62 bp, artificial sequence
  Description of artificial sequence: synthetic polynucleotide
tgtttatggttacttatactagcatgaaggtaccttgtcgttgtatataaacctaaccctct

SEQ ID NO: 345 - DNA, 63 bp, artificial sequence
  Description of artificial sequence: synthetic polynucleotide
tgtttatggttacttatcactagcatgaaggtaccttgtcgttgtatataaacctaaccctct

SEQ ID NO: 346 - DNA, 64 bp, artificial sequence
  Description of artificial sequence: synthetic polynucleotide
tgtttatggttacttatcactagcatgaaggtaccttgtcgttgatatataaacctaaccctct

SEQ ID NO: 347 - DNA, 65 bp, artificial sequence
  Description of artificial sequence: synthetic polynucleotide
tgtttatggttacttatccactagcatgaaggtaccttgtcgttgatatataaacctaaccctct

SEQ ID NO: 348 - DNA, 66 bp, artificial sequence
  Description of artificial sequence: synthetic polynucleotide
tgtttatggttacttatccactagcatgaaggtaccttgtcgttgattatataaacctaaccctct

SEQ ID NO: 349 - DNA, 67 bp, artificial sequence
  Description of artificial sequence: synthetic polynucleotide
tgtttatggttacttataccactagcatgaaggtaccttgtcgttgattatataaacctaaccctct

SEQ ID NO: 350 - DNA, 68 bp, artificial sequence
  Description of artificial sequence: synthetic polynucleotide
tgtttatggttacttataccactagcatgaaggtaccttgtcgttgatttatataaacctaaccctct

SEQ ID NO: 351 - DNA, 69 bp, artificial sequence
  Description of artificial sequence: synthetic polynucleotide
tgtttatggttacttatgaccactagcatgaaggtaccttgtcgttgatttatataaacctaaccctct

SEQ ID NO: 352 - DNA, 70 bp, artificial sequence
  Description of artificial sequence: synthetic polynucleotide
tgtttatggttacttatgaccactagcatgaaggtaccttgtcgttgattctatataaacctaaccctct

SEQ ID NO: 353 - DNA, 71 bp, artificial sequence
  Description of artificial sequence: synthetic polynucleotide
tgtttatggttacttattgaccactagcatgaaggtaccttgtcgttgattctatataaacctaaccctct

SEQ ID NO: 354 - DNA, 72 bp, artificial sequence
  Description of artificial sequence: synthetic polynucleotide
tgtttatggttacttattgaccactagcatgaaggtaccttgtcgttgattcatatataaacctaaccctct

SEQ ID NO: 355 - DNA, 73 bp, artificial sequence
  Description of artificial sequence: synthetic polynucleotide
tgtttatggttacttatctgaccactagcatgaaggtaccttgtcgttgattcatatataaacctaaccctct

SEQ ID NO: 356 - DNA, 74 bp, artificial sequence
  Description of artificial sequence: synthetic polynucleotide
tgtttatggttacttatctgaccactagcatgaaggtaccttgtcgttgattcagtatataaacctaaccctct

SEQ ID NO: 357 - DNA, 75 bp, artificial sequence
  Description of artificial sequence: synthetic polynucleotide
tgtttatggttacttattctgaccactagcatgaaggtaccttgtcgttgattcagtatataaacctaaccctct

SEQ ID NO: 358 - DNA, 76 bp, artificial sequence
  Description of artificial sequence: synthetic polynucleotide
tgtttatggttacttattctgaccactagcatgaaggtaccttgtcgttgattcagttatataaacctaaccctct

SEQ ID NO: 359 - DNA, 1605 bp, artificial sequence
  Description of artificial sequence: synthetic polynucleotide
accgcgtctctctcccagtctgatattgtgaagatcgctggaaacattgggggcgctcaagctctccaggctgtgcttgatctcgaatccatgctcggcaagcgcggcttctccagggatgacatcgcaaaaatggcaggaaacggcggaggggcccagacactgcaagccgtcttggacctggagtccgcttttagggagagaggcttcagccaggccgacattgtgaaaatcgctggcaacatagggggcgcccaggccctgtatagcgtgttggacgtcgaaccaactctgggcaaacggggatttagcagggctgacatcgtcaaaattgccgggaacggaggcggagcccaggcacttcacaccgtgttggatttggaacccgccctgggcaagagggggtttagtcggatcgacatcgtgaaaattgcagccaacgggggcggggctcaggctcttcatgccgtgctcgatctcggccccacactccgggagtgtggcttctcccaggcaactatcgccaagattgcaggcaacggcggcggggcccaagctcttcagatggtgcttgacctggggcctgccctcggaaagagagggttttcacaggccaccattgccaaaatcgccggcaacatcggcggggcacaggcccttcagacagtgctcgacctggagcccgccctgtgcgagaggggattcagtcaggccacaatcgccaaaatggccgggaatattgggggagcccaagccctccagaccgtgctggatctggagccagcactgaggaagagggatttccgccaggcagatattattaaaattgctgggaataatgggggagcccaagccctccaggctgtcatcgagcacgggcctacacttcggcagcacgggtttaacctggccgatattgtcaagatggccggcaacgacggaggagcccaggcactgcaagccgtccttgacttgaagcccgtcctcgatgagcatggattctctcagcccgatatagtcaaaatggccggaaacattgggggcgctcaggctctgcaagctgtgctctccctcggacccgcactcagggagagggggttcagtcagccagacattgtgaagatcgccgggaacgatggaggcgcccaggcccttcaggcagtgttggatctggagctgaccctcgtggagcatggctttagccaggctgatattgtgaaaatcgctggaaacggcggcggcactcaggccctgcacgccgtgttggacctcgaacggatgctgggagagagagggttttcaagagccgacattgtcaacgtcgctgggaacggagggggggcccaggctcttaaggccgtgctggaacacgaagccacactgaacgagcggggcttcaacctgacagacatcgtggaaatggcagccaacatcggcggcgcacaggccctgaaggctgtgctggagcacggccctaccctcaggcagaggggcctgagcctgatcgacatcgtcgaaatcgcaggaaatgggggcggggcccaagcactgaaagctgtcttgaagtacggaccagtgctgatgcaggcagggagaggagacgcc

SEQ ID NO: 360 - DNA, 17 bp, artificial sequence
  Description of artificial sequence: synthetic polynucleotide
tatatttaagcacttat

SEQ ID NO: 361 - DNA, 2628 bp, artificial sequence
  Description of artificial sequence: synthetic polynucleotide
atgggcgatcctaaaaagaaacgtaaggtcatcgattacccatacgatgttccagattacgctatcgatatcgcctcaaccgccttcgtggaccaggataagcaaatggccaaccgcttgaacctgagtcccctggagaggtctaagattgagaagcagtacggcggggccacaactctggcctttatctccaacaagcagaacgagctggcccagatccttagccgggcagacatcttgaagattgcctcctatgattgtgctgcacacgccctccaggctgtcctcgattgcgggccaatgctggggaagagaggattctcccagtctgatattgtgaagatcgctggaaacattgggggcgctcaagctctccaggctgtgcttgatctcgaatccatgctcggcaagcgcggcttctccagggatgacatcgcaaaaatggcaggaaacggcggaggggcccagacactgcaagccgtcttggacctggagtccgcttttagggagagaggcttcagccaggccgacattgtgaaaatcgctggcaacatagggggcgcccaggccctgtatagcgtgttggacgtcgaaccaactctgggcaaacggggatttagcagggctgacatcgtcaaaattgccgggaacggaggcggagcccaggcacttcacaccgtgttggatttggaacccgccctgggcaagagggggtttagtcggatcgacatcgtgaaaattgcagccaacgggggcggggctcaggctcttcatgccgtgctcgatctcggccccacactccgggagtgtggcttctcccaggcaactatcgccaagattgcaggcaacggcggcggggcccaagctcttcagatggtgcttgacctggggcctgccctcggaaagagagggttttcacaggccaccattgccaaaatcgccggcaacatcggcggggcacaggcccttcagacagtgctcgacctggagcccgccctgtgcgagaggggattcagtcaggccacaatcgccaaaatggccgggaatattgggggagcccaagccctccagaccgtgctggatctggagccagcactgaggaagagggatttccgccaggcagatattattaaaattgctgggaataatgggggagcccaagccctccaggctgtcatcgagcacgggcctacacttcggcagcacgggtttaacctggccgatattgtcaagatggccggcaacgacggaggagcccaggcactgcaagccgtccttgacttgaagcccgtcctcgatgagcatggattctctcagcccgatatagtcaaaatggccggaaacattgggggcgctcaggctctgcaagctgtgctctccctcggacccgcactcagggagagggggttcagtcagccagacattgtgaagatcgccgggaacgatggaggcgcccaggcccttcaggcagtgttggatctggagctgaccctcgtggagcatggctttagccaggctgatattgtgaaaatcgctggaaacggcggcggcactcaggccctgcacgccgtgttggacctcgaacggatgctgggagagagagggttttcaagagccgacattgtcaacgtcgctgggaacggagggggggcccaggctcttaaggccgtgctggaacacgaagccacactgaacgagcggggcttcaacctgacagacatcgtggaaatggcagccaacatcggcggcgcacaggccctgaaggctgtgctggagcacggccctaccctcaggcagaggggcctgagcctgatcgacatcgtcgaaatcgcaggaaatgggggcggggcccaagcactgaaagctgtcttgaagtacggaccagtgctgatgcaggcagggagaagcaatgaggaaatcgtccatgtggccgctagaaggggcggagccggcaggattcggaaaatggtggcccctctcctggagcggcagggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 362 - DNA, 1605 bp, artificial sequence
  Description of artificial sequence: synthetic polynucleotide
accgcgtctctctcccagtctgatattgtgaagatcgctggaaacaacgggggcgctcaagctctccaggctgtgcttgatctcgaatccatgctcggcaagcgcggcttctccagggatgacatcgcaaaaatggcaggaaacggcggaggggcccagacactgcaagccgtcttggacctggagtccgcttttagggagagaggcttcagccaggccgacattgtgaaaatcgctggcaacggagggggcgcccaggccctgtatagcgtgttggacgtcgaaccaactctgggcaaacggggatttagcagggctgacatcgtcaaaattgccgggaacggaggcggagcccaggcacttcacaccgtgttggatttggaacccgccctgggcaagagggggtttagtcggatcgacatcgtgaaaattgcagccaacagtggcggggctcaggctcttcatgccgtgctcgatctcggccccacactccgggagtgtggcttctcccaggcaactatcgccaagattgcaggcaacggcggcggggcccaagctcttcagatggtgcttgacctggggcctgccctcggaaagagagggttttcacaggccaccattgccaaaatcgccggcaacaatggcggggcacaggcccttcagacagtgctcgacctggagcccgccctgtgcgagaggggattcagtcaggccacaatcgccaaaatggccgggaataacgggggagcccaagccctccagaccgtgctggatctggagccagcactgaggaagagggatttccgccaggcagatattattaaaattgctgggaatggagggggagcccaagccctccaggctgtcatcgagcacgggcctacacttcggcagcacgggtttaacctggccgatattgtcaagatggccggcaacggaggaggagcccaggcactgcaagccgtccttgacttgaagcccgtcctcgatgagcatggattctctcagcccgatatagtcaaaatggccggaaactctgggggcgctcaggctctgcaagctgtgctctccctcggacccgcactcagggagagggggttcagtcagccagacattgtgaagatcgccgggaacgatggaggcgcccaggcccttcaggcagtgttggatctggagctgaccctcgtggagcatggctttagccaggctgatattgtgaaaatcgctggaaacggcggcggcactcaggccctgcacgccgtgttggacctcgaacggatgctgggagagagagggttttcaagagccgacattgtcaacgtcgctgggaacggagggggggcccaggctcttaaggccgtgctggaacacgaagccacactgaacgagcggggcttcaacctgacagacatcgtggaaatggcagccaacagcggcggcgcacaggccctgaaggctgtgctggagcacggccctaccctcaggcagaggggcctgagcctgatcgacatcgtcgaaatcgcaggaaatgggggcggggcccaagcactgaaagctgtcttgaagtacggaccagtgctgatgcaggcagggagaggagacgcc

SEQ ID NO: 363 - DNA, 2628 bp, artificial sequence
  Description of artificial sequence: synthetic polynucleotide
atgggcgatcctaaaaagaaacgtaaggtcatcgattacccatacgatgttccagattacgctatcgatatcgcctcaaccgccttcgtggaccaggataagcaaatggccaaccgcttgaacctgagtcccctggagaggtctaagattgagaagcagtacggcggggccacaactctggcctttatctccaacaagcagaacgagctggcccagatccttagccgggcagacatcttgaagattgcctcctatgattgtgctgcacacgccctccaggctgtcctcgattgcgggccaatgctggggaagagaggattctcccagtctgatattgtgaagatcgctggaaacaacgggggcgctcaagctctccaggctgtgcttgatctcgaatccatgctcggcaagcgcggcttctccagggatgacatcgcaaaaatggcaggaaacggcggaggggcccagacactgcaagccgtcttggacctggagtccgcttttagggagagaggcttcagccaggccgacattgtgaaaatcgctggcaacggagggggcgcccaggccctgtatagcgtgttggacgtcgaaccaactctgggcaaacggggatttagcagggctgacatcgtcaaaattgccgggaacggaggcggagcccaggcacttcacaccgtgttggatttggaacccgccctgggcaagagggggtttagtcggatcgacatcgtgaaaattgcagccaacagtggcggggctcaggctcttcatgccgtgctcgatctcggccccacactccgggagtgtggcttctcccaggcaactatcgccaagattgcaggcaacggcggcggggcccaagctcttcagatggtgcttgacctggggcctgccctcggaaagagagggttttcacaggccaccattgccaaaatcgccggcaacaatggcggggcacaggcccttcagacagtgctcgacctggagcccgccctgtgcgagaggggattcagtcaggccacaatcgccaaaatggccgggaataacgggggagcccaagccctccagaccgtgctggatctggagccagcactgaggaagagggatttccgccaggcagatattattaaaattgctgggaatggagggggagcccaagccctccaggctgtcatcgagcacgggcctacacttcggcagcacgggtttaacctggccgatattgtcaagatggccggcaacggaggaggagcccaggcactgcaagccgtccttgacttgaagcccgtcctcgatgagcatggattctctcagcccgatatagtcaaaatggccggaaactctgggggcgctcaggctctgcaagctgtgctctccctcggacccgcactcagggagagggggttcagtcagccagacattgtgaagatcgccgggaacgatggaggcgcccaggcccttcaggcagtgttggatctggagctgaccctcgtggagcatggctttagccaggctgatattgtgaaaatcgctggaaacggcggcggcactcaggccctgcacgccgtgttggacctcgaacggatgctgggagagagagggttttcaagagccgacattgtcaacgtcgctgggaacggagggggggcccaggctcttaaggccgtgctggaacacgaagccacactgaacgagcggggcttcaacctgacagacatcgtggaaatggcagccaacagcggcggcgcacaggccctgaaggctgtgctggagcacggccctaccctcaggcagaggggcctgagcctgatcgacatcgtcgaaatcgcaggaaatgggggcggggcccaagcactgaaagctgtcttgaagtacggaccagtgctgatgcaggcagggagaagcaatgaggaaatcgtccatgtggccgctagaaggggcggagccggcaggattcggaaaatggtggcccctctcctggagcggcagggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 364 - DNA, 1605 bp, artificial sequence
  Description of artificial sequence: synthetic polynucleotide
accgcgtctctctcccagtctgatattgtgaagatcgctggaaacagggggggcgctcaagctctccaggctgtgcttgatctcgaatccatgctcggcaagcgcggcttctccagggatgacatcgcaaaaatggcaggaaacggcggaggggcccagacactgcaagccgtcttggacctggagtccgcttttagggagagaggcttcagccaggccgacattgtgaaaatcgctggcaacggagggggcgcccaggccctgtatagcgtgttggacgtcgaaccaactctgggcaaacggggatttagcagggctgacatcgtcaaaattgccgggaacggaggcggagcccaggcacttcacaccgtgttggatttggaacccgccctgggcaagagggggtttagtcggatcgacatcgtgaaaattgcagccaacattggcggggctcaggctcttcatgccgtgctcgatctcggccccacactccgggagtgtggcttctcccaggcaactatcgccaagattgcaggcaacggcggcggggcccaagctcttcagatggtgcttgacctggggcctgccctcggaaagagagggttttcacaggccaccattgccaaaatcgccggcaacagaggcggggcacaggcccttcagacagtgctcgacctggagcccgccctgtgcgagaggggattcagtcaggccacaatcgccaaaatggccgggaatagggggggagcccaagccctccagaccgtgctggatctggagccagcactgaggaagagggatttccgccaggcagatattattaaaattgctgggaatggagggggagcccaagccctccaggctgtcatcgagcacgggcctacacttcggcagcacgggtttaacctggccgatattgtcaagatggccggcaacggaggaggagcccaggcactgcaagccgtccttgacttgaagcccgtcctcgatgagcatggattctctcagcccgatatagtcaaaatggccggaaacattgggggcgctcaggctctgcaagctgtgctctccctcggacccgcactcagggagagggggttcagtcagccagacattgtgaagatcgccgggaacgatggaggcgcccaggcccttcaggcagtgttggatctggagctgaccctcgtggagcatggctttagccaggctgatattgtgaaaatcgctggaaacggcggcggcactcaggccctgcacgccgtgttggacctcgaacggatgctgggagagagagggttttcaagagccgacattgtcaacgtcgctgggaacggagggggggcccaggctcttaaggccgtgctggaacacgaagccacactgaacgagcggggcttcaacctgacagacatcgtggaaatggcagccaacatcggcggcgcacaggccctgaaggctgtgctggagcacggccctaccctcaggcagaggggcctgagcctgatcgacatcgtcgaaatcgcaggaaatgggggcggggcccaagcactgaaagctgtcttgaagtacggaccagtgctgatgcaggcagggagaggagacgcc

SEQ ID NO: 365 - DNA, 2628 bp, artificial sequence
  Description of artificial sequence: synthetic polynucleotide
atgggcgatcctaaaaagaaacgtaaggtcatcgattacccatacgatgttccagattacgctatcgatatcgcctcaaccgccttcgtggaccaggataagcaaatggccaaccgcttgaacctgagtcccctggagaggtctaagattgagaagcagtacggcggggccacaactctggcctttatctccaacaagcagaacgagctggcccagatccttagccgggcagacatcttgaagattgcctcctatgattgtgctgcacacgccctccaggctgtcctcgattgcgggccaatgctggggaagagaggattctcccagtctgatattgtgaagatcgctggaaacagggggggcgctcaagctctccaggctgtgcttgatctcgaatccatgctcggcaagcgcggcttctccagggatgacatcgcaaaaatggcaggaaacggcggaggggcccagacactgcaagccgtcttggacctggagtccgcttttagggagagaggcttcagccaggccgacattgtgaaaatcgctggcaacggagggggcgcccaggccctgtatagcgtgttggacgtcgaaccaactctgggcaaacggggatttagcagggctgacatcgtcaaaattgccgggaacggaggcggagcccaggcacttcacaccgtgttggatttggaacccgccctgggcaagagggggtttagtcggatcgacatcgtgaaaattgcagccaacattggcggggctcaggctcttcatgccgtgctcgatctcggccccacactccgggagtgtggcttctcccaggcaactatcgccaagattgcaggcaacggcggcggggcccaagctcttcagatggtgcttgacctggggcctgccctcggaaagagagggttttcacaggccaccattgccaaaatcgccggcaacagaggcggggcacaggcccttcagacagtgctcgacctggagcccgccctgtgcgagaggggattcagtcaggccacaatcgccaaaatggccgggaatagggggggagcccaagccctccagaccgtgctggatctggagccagcactgaggaagagggatttccgccaggcagatattattaaaattgctgggaatggagggggagcccaagccctccaggctgtcatcgagcacgggcctacacttcggcagcacgggtttaacctggccgatattgtcaagatggccggcaacggaggaggagcccaggcactgcaagccgtccttgacttgaagcccgtcctcgatgagcatggattctctcagcccgatatagtcaaaatggccggaaacattgggggcgctcaggctctgcaagctgtgctctccctcggacccgcactcagggagagggggttcagtcagccagacattgtgaagatcgccgggaacgatggaggcgcccaggcccttcaggcagtgttggatctggagctgaccctcgtggagcatggctttagccaggctgatattgtgaaaatcgctggaaacggcggcggcactcaggccctgcacgccgtgttggacctcgaacggatgctgggagagagagggttttcaagagccgacattgtcaacgtcgctgggaacggagggggggcccaggctcttaaggccgtgctggaacacgaagccacactgaacgagcggggcttcaacctgacagacatcgtggaaatggcagccaacatcggcggcgcacaggccctgaaggctgtgctggagcacggccctaccctcaggcagaggggcctgagcctgatcgacatcgtcgaaatcgcaggaaatgggggcggggcccaagcactgaaagctgtcttgaagtacggaccagtgctgatgcaggcagggagaagcaatgaggaaatcgtccatgtggccgctagaaggggcggagccggcaggattcggaaaatggtggcccctctcctggagcggcagggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 366 - protein, 135 aa, artificial sequence
  Description of artificial sequence: synthetic polypeptide
DLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLN

SEQ ID NO: 367 - DNA, 2236 bp, artificial sequence
  Description of artificial sequence: synthetic polynucleotide
ggcgcgccactagcgctctcgaggtcacgcgccaagccgccaccatgggcgatcctaaaaagaaacgtaaggtcatcgataaggagaccgccgctgccaagttcgagagacagcacatggacagcatcgatatcgccgacctgaggacactggggtactcccaacagcagcaagaaaagatcaagcccaaggtgcgcagcaccgtggcccagcaccacgaggccctggtcggccacgggttcactcacgcccatatcgtggctttgagtcagcatcccgccgccctcgggaccgtcgctgtgaagtatcaggatatgattgccgccctgcccgaggccactcacgaggctattgtgggcgtcggcaagcagtggtcaggcgcaagggcactggaggctctcttgacagtcgccggggagctgagaggcccacctctccagttggatacaggccaactgctgaaaattgccaagagagggggagtgacagcagtggaggccgtccacgcctggcggaatgccctcaccggagccccacttaactttagtccatctgatattgcaaagatcactggaaacaacgggggcacacaagctctccaggctgtgcttgatctcgaatccatgctcggcaagcgcggcttctccagggatgacatcgcaaaaatggcaggaaacggaggaggggcccagacactgcaagccgtcttggacctggagtccgcttttagggagagaggcttcagccaggccgacattgtgaaaatcgctggcaacggagggggcgcccaggccctgtatagcgtgttggacgtcgaaccaactctgggcaaacggggatttagcagggctgacatcgtcaaaattgccgggaacggaggcggagcccaggcacttcacaccgtgttggatttggaacccgccctgggcaagagggggtttagtcggatcgacatcgtgaaaattgcagccaacattggcggggctcaggctcttcatgccgtgctcgatctcggccccacactccgggagtgtggcttctcccaggcaactatcgccaagattgcaggcaacggcggcggggcccaagctcttcagatggtgcttgacctggggcctgccctcggaaagagagggttttcacaggccaccattgccaaaatcgccggcaacaatggcggggcacaggcccttcagacagtgctcgacctggagcccgccctgtgcgagaggggattcagtcaggccacaatcgccaaaatggccgggaataatgggggagcccaagccctccagaccgtgctggatctggagccagcactgaggaagagggatttccgccaggcagatattattaaaattgctgggaacggagggggagcccaagccctccaggctgtcatcgagcacgggcctacacttcggcagcacgggtttaacctggccgatattgtcaagatggccggcaacggaggaggagcccaggcactgcaagccgtccttgacttgaagcccgtcctcgatgagcatggattctctcagcccgatatagtcaaaatggccggaaacatcgggggcgctcaggctctgcaagctgtgctctccctcggacccgcactcagggagagggggttcagtcagccagacattgtgaagatcgccgggcacgatggaggcgcccaggcccttcaggcagtgttggatctggagctgaccctcgtggagcatggctttagccaggctgatattgtgaaaatcgctggaaacggaggcggcactcaggccctgcacgccgtgttggacctcgaacggatgctgggagagagagggttttcaagagccgacattgtcaacgtcgctgggaatggggggggggcccaggctcttaaggccgtgctggaacacgaagccacactgaacgagcggggcttcaacctgacagacatcgtggaaatggcagccaacattggcggcgcacaggccctgaaggctgtgctggagcacggccctaccctcaggcagaggggcctgagcctgatcgacatcgtcgaaatcgcaggaaatgggggcggggcccaagcactgaaagctgtcttgaagtacggaccagtgctgatgcaggcaggaagatcaaatgaagaaattgtgcatgtggctgctagaagaggaggcgccggaagaattagaaagatggtggccccactcttggagagacagggcagatctggctcggatcc

SEQ ID NO: 368 - DNA, 2218 bp, artificial sequence
  Description of artificial sequence: synthetic polynucleotide
ggcgcgccactagcgctctcgaggtcacgcgccaagccgccaccatgggcgatcctaaaaagaaacgtaaggtcatcgattacccatacgatgttccagattacgctatcgatatcgccgacctgaggacactggggtactcccaacagcagcaagaaaagatcaagcccaaggtgcgcagcaccgtggcccagcaccacgaggccctggtcggccacgggttcactcacgcccatatcgtggctttgagtcagcatcccgccgccctcgggaccgtcgctgtgaagtatcaggatatgattgccgccctgcccgaggccactcacgaggctattgtgggcgtcggcaagcagtggtcaggcgcaagggcactggaggctctcttgacagtcgccggggagctgagaggcccacctctccagttggatacaggccaactgctgaaaattgccaagagagggggagtgacagcagtggaggccgtccacgcctggcggaatgccctcaccggagccccacttaactttagtccatctgatattgcaaagatcactggaaacattgggggcacacaagctctccaggctgtgcttgatctcgaatccatgctcggcaagcgcggcttctccagggatgacatcgcaaaaatggcaggaaacggaggaggggcccagacactgcaagccgtcttggacctggagtccgcttttagggagagaggcttcagccaggccgacattgtgaaaatcgctggcaacatcgggggcgcccaggccctgtatagcgtgttggacgtcgaaccaactctgggcaaacggggatttagcagggctgacatcgtcaaaattgccgggaacggaggcggagcccaggcacttcacaccgtgttggatttggaacccgccctgggcaagagggggtttagtcggatcgacatcgtgaaaattgcagccaacgggggcggggctcaggctcttcatgccgtgctcgatctcggccccacactccgggagtgtggcttctcccaggcaactatcgccaagattgcaggcaacggcggcggggcccaagctcttcagatggtgcttgacctggggcctgccctcggaaagagagggttttcacaggccaccattgccaaaatcgccggcaacatcggcggggcacaggcccttcagacagtgctcgacctggagcccgccctgtgcgagaggggattcagtcaggccacaatcgccaaaatggccgggaatattgggggagcccaagccctccagaccgtgctggatctggagccagcactgaggaagagggatttccgccaggcagatattattaaaattgctgggaacaatgggggagcccaagccctccaggctgtcatcgagcacgggcctacacttcggcagcacgggtttaacctggccgatattgtcaagatggccggccacgacggaggagcccaggcactgcaagccgtccttgacttgaagcccgtcctcgatgagcatggattctctcagcccgatatagtcaaaatggccggaaacatcgggggcgctcaggctctgcaagctgtgctctccctcggacccgcactcagggagagggggttcagtcagccagacattgtgaagatcgccgggcacgatggaggcgcccaggcccttcaggcagtgttggatctggagctgaccctcgtggagcatggctttagccaggctgatattgtgaaaatcgctggaaacggaggcggcactcaggccctgcacgccgtgttggacctcgaacggatgctgggagagagagggttttcaagagccgacattgtcaacgtcgctgggaatggggggggggcccaggctcttaaggccgtgctggaacacgaagccacactgaacgagcggggcttcaacctgacagacatcgtggaaatggcagccaacattggcggcgcacaggccctgaaggctgtgctggagcacggccctaccctcaggcagaggggcctgagcctgatcgacatcgtcgaaatcgcaggaaatgggggcggggcccaagcactgaaagctgtcttgaagtacggaccagtgctgatgcaggcaggaagatcaaatgaagaaattgtgcatgtggctgctagaagaggaggcgccggaagaattagaaagatggtggccccactcttggagagacagggcagatctggctcggatcc

SEQ ID NO: 369 - DNA, 2790 bp, artificial sequence
  Description of artificial sequence: synthetic polynucleotide
atgggcgatcctaaaaagaaacgtaaggtcatcgattacccatacgatgttccagattacgctatcgatatcgccgacctgaggacactggggtactcccaacagcagcaagaaaagatcaagcccaaggtgcgcagcaccgtggcccagcaccacgaggccctggtcggccacgggttcactcacgcccatatcgtggctttgagtcagcatcccgccgccctcgggaccgtcgctgtgaagtatcaggatatgattgccgccctgcccgaggccactcacgaggctattgtgggcgtcggcaagcagtggtcaggcgcaagggcactggaggctctcttgacagtcgccggggagctgagaggcccacctctccagttggatacaggccaactgctgaaaattgccaagagagggggagtgacagcagtggaggccgtccacgcctggcggaatgccctcaccggagccccacttaactttagtccatctgatattgcaaagatcactggaaacattgggggcacacaagctctccaggctgtgcttgatctcgaatccatgctcggcaagcgcggcttctccagggatgacatcgcaaaaatggcaggaaacggaggaggggcccagacactgcaagccgtcttggacctggagtccgcttttagggagagaggcttcagccaggccgacattgtgaaaatcgctggcaacatcgggggcgcccaggccctgtatagcgtgttggacgtcgaaccaactctgggcaaacggggatttagcagggctgacatcgtcaaaattgccgggaacggaggcggagcccaggcacttcacaccgtgttggatttggaacccgccctgggcaagagggggtttagtcggatcgacatcgtgaaaattgcagccaacgggggcggggctcaggctcttcatgccgtgctcgatctcggccccacactccgggagtgtggcttctcccaggcaactatcgccaagattgcaggcaacggcggcggggcccaagctcttcagatggtgcttgacctggggcctgccctcggaaagagagggttttcacaggccaccattgccaaaatcgccggcaacatcggcggggcacaggcccttcagacagtgctcgacctggagcccgccctgtgcgagaggggattcagtcaggccacaatcgccaaaatggccgggaatattgggggagcccaagccctccagaccgtgctggatctggagccagcactgaggaagagggatttccgccaggcagatattattaaaattgctgggaacaatgggggagcccaagccctccaggctgtcatcgagcacgggcctacacttcggcagcacgggtttaacctggccgatattgtcaagatggccggccacgacggaggagcccaggcactgcaagccgtccttgacttgaagcccgtcctcgatgagcatggattctctcagcccgatatagtcaaaatggccggaaacatcgggggcgctcaggctctgcaagctgtgctctccctcggacccgcactcagggagagggggttcagtcagccagacattgtgaagatcgccgggcacgatggaggcgcccaggcccttcaggcagtgttggatctggagctgaccctcgtggagcatggctttagccaggctgatattgtgaaaatcgctggaaacggaggcggcactcaggccctgcacgccgtgttggacctcgaacggatgctgggagagagagggttttcaagagccgacattgtcaacgtcgctgggaatggggggggggcccaggctcttaaggccgtgctggaacacgaagccacactgaacgagcggggcttcaacctgacagacatcgtggaaatggcagccaacattggcggcgcacaggccctgaaggctgtgctggagcacggccctaccctcaggcagaggggcctgagcctgatcgacatcgtcgaaatcgcaggaaatgggggcggggcccaagcactgaaagctgtcttgaagtacggaccagtgctgatgcaggcaggaagatcaaatgaagaaattgtgcatgtggctgctagaagaggaggcgccggaagaattagaaagatggtggccccactcttggagagacagggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 370 - protein, 928 aa, artificial sequence
  Description of artificial sequence: synthetic polypeptide
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNFSPSDIAKITGNIGGTQALQAVLDLESMLGKRGFSRDDIAKMAGNGGGAQTLQAVLDLESAFRERGFSQADIVKIAGNIGGAQALYSVLDVEPTLGKRGFSRADIVKIAGNGGGAQALHTVLDLEPALGKRGFSRIDIVKIAANGGGAQALHAVLDLGPTLRECGFSQATIAKIAGNGGGAQALQMVLDLGPALGKRGFSQATIAKIAGNIGGAQALQTVLDLEPALCERGFSQATIAKMAGNIGGAQALQTVLDLEPALRKRDFRQADIIKIAGNNGGAQALQAVIEHGPTLRQHGFNLADIVKMAGHDGGAQALQAVLDLKPVLDEHGFSQPDIVKMAGNIGGAQALQAVLSLGPALRERGFSQPDIVKIAGHDGGAQALQAVLDLELTLVEHGFSQADIVKIAGNGGGTQALHAVLDLERMLGERGFSRADIVNVAGNGGGAQALKAVLEHEATLNERGFNLTDIVEMAANIGGAQALKAVLEHGPTLRQRGLSLIDIVEIAGNGGGAQALKAVLKYGPVLMQAGRSNEEIVHVAARRGGAGRIRKMVAPLLERQGRSGSDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 371 - DNA, 2808 bp, artificial sequence
  Description of artificial sequence: synthetic polynucleotide
atgggcgatcctaaaaagaaacgtaaggtcatcgataaggagaccgccgctgccaagttcgagagacagcacatggacagcatcgatatcgccgacctgaggacactggggtactcccaacagcagcaagaaaagatcaagcccaaggtgcgcagcaccgtggcccagcaccacgaggccctggtcggccacgggttcactcacgcccatatcgtggctttgagtcagcatcccgccgccctcgggaccgtcgctgtgaagtatcaggatatgattgccgccctgcccgaggccactcacgaggctattgtgggcgtcggcaagcagtggtcaggcgcaagggcactggaggctctcttgacagtcgccggggagctgagaggcccacctctccagttggatacaggccaactgctgaaaattgccaagagagggggagtgacagcagtggaggccgtccacgcctggcggaatgccctcaccggagccccacttaactttagtccatctgatattgcaaagatcactggaaacaacgggggcacacaagctctccaggctgtgcttgatctcgaatccatgctcggcaagcgcggcttctccagggatgacatcgcaaaaatggcaggaaacggaggaggggcccagacactgcaagccgtcttggacctggagtccgcttttagggagagaggcttcagccaggccgacattgtgaaaatcgctggcaacggagggggcgcccaggccctgtatagcgtgttggacgtcgaaccaactctgggcaaacggggatttagcagggctgacatcgtcaaaattgccgggaacggaggcggagcccaggcacttcacaccgtgttggatttggaacccgccctgggcaagagggggtttagtcggatcgacatcgtgaaaattgcagccaacattggcggggctcaggctcttcatgccgtgctcgatctcggccccacactccgggagtgtggcttctcccaggcaactatcgccaagattgcaggcaacggcggcggggcccaagctcttcagatggtgcttgacctggggcctgccctcggaaagagagggttttcacaggccaccattgccaaaatcgccggcaacaatggcggggcacaggcccttcagacagtgctcgacctggagcccgccctgtgcgagaggggattcagtcaggccacaatcgccaaaatggccgggaataatgggggagcccaagccctccagaccgtgctggatctggagccagcactgaggaagagggatttccgccaggcagatattattaaaattgctgggaacggagggggagcccaagccctccaggctgtcatcgagcacgggcctacacttcggcagcacgggtttaacctggccgatattgtcaagatggccggcaacggaggaggagcccaggcactgcaagccgtccttgacttgaagcccgtcctcgatgagcatggattctctcagcccgatatagtcaaaatggccggaaacatcgggggcgctcaggctctgcaagctgtgctctccctcggacccgcactcagggagagggggttcagtcagccagacattgtgaagatcgccgggcacgatggaggcgcccaggcccttcaggcagtgttggatctggagctgaccctcgtggagcatggctttagccaggctgatattgtgaaaatcgctggaaacggaggcggcactcaggccctgcacgccgtgttggacctcgaacggatgctgggagagagagggttttcaagagccgacattgtcaacgtcgctgggaatggggggggggcccaggctcttaaggccgtgctggaacacgaagccacactgaacgagcggggcttcaacctgacagacatcgtggaaatggcagccaacattggcggcgcacaggccctgaaggctgtgctggagcacggccctaccctcaggcagaggggcctgagcctgatcgacatcgtcgaaatcgcaggaaatgggggcggggcccaagcactgaaagctgtcttgaagtacggaccagtgctgatgcaggcaggaagatcaaatgaagaaattgtgcatgtggctgctagaagaggaggcgccggaagaattagaaagatggtggccccactcttggagagacagggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 372 - protein, 934 aa, artificial sequence
  Description of artificial sequence: synthetic polypeptide
MGDPKKKRKVIDKETAAAKFERQHMDSIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNFSPSDIAKITGNNGGTQALQAVLDLESMLGKRGFSRDDIAKMAGNGGGAQTLQAVLDLESAFRERGFSQADIVKIAGNGGGAQALYSVLDVEPTLGKRGFSRADIVKIAGNGGGAQALHTVLDLEPALGKRGFSRIDIVKIAANIGGAQALHAVLDLGPTLRECGFSQATIAKIAGNGGGAQALQMVLDLGPALGKRGFSQATIAKIAGNNGGAQALQTVLDLEPALCERGFSQATIAKMAGNNGGAQALQTVLDLEPALRKRDFRQADIIKIAGNGGGAQALQAVIEHGPTLRQHGFNLADIVKMAGNGGGAQALQAVLDLKPVLDEHGFSQPDIVKMAGNIGGAQALQAVLSLGPALRERGFSQPDIVKIAGHDGGAQALQAVLDLELTLVEHGFSQADIVKIAGNGGGTQALHAVLDLERMLGERGFSRADIVNVAGNGGGAQALKAVLEHEATLNERGFNLTDIVEMAANIGGAQALKAVLEHGPTLRQRGLSLIDIVEIAGNGGGAQALKAVLKYGPVLMQAGRSNEEIVHVAARRGGAGRIRKMVAPLLERQGRSGSDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 373 - DNA, 558 bp, artificial sequence
  Description of artificial sequence: synthetic polynucleotide
ggcgcgccactagcgctctcgaggtcacgcgccaagccgccaccatgggcgatcctaaaaagaaacgtaaggtcatcgattacccatacgatgttccagattacgctatcgatatcgccgacctgaggacactggggtactcccaacagcagcaagaaaagatcaagcccaaggtgcgcagcaccgtggcccagcaccacgaggccctggtcggccacgggttcactcacgcccatatcgtggctttgagtcagcatcccgccgccctcgggaccgtcgctgtgaagtatcaggatatgattgccgccctgcccgaggccactcacgaggctattgtgggcgtcggcaagcagtggtcaggcgcaagggcactggaggctctcttgacagtcgccggggagctgagaggcccacctctccaggcagatacaggcaacctgctgaaaatggccaagaaagggggagtgacaggggtggaggccgcccacgcctggcggaatgccctcaccggagccccacttaacttctccggagacgcccgggggatcaggtcacgtg

SEQ ID NO: 374 - DNA, 576 bp, artificial sequence
  Description of artificial sequence: synthetic polynucleotide
ggcgcgccactagcgctctcgaggtcacgcgccaagccgccaccatgggcgatcctaaaaagaaacgtaaggtcatcgataaggagaccgccgctgccaagttcgagagacagcacatggacagcatcgatatcgccgacctgaggacactggggtactcccaacagcagcaagaaaagatcaagcccaaggtgcgcagcaccgtggcccagcaccacgaggccctggtcggccacgggttcactcacgcccatatcgtggctttgagtcagcatcccgccgccctcgggaccgtcgctgtgaagtatcaggatatgattgccgccctgcccgaggccactcacgaggctattgtgggcgtcggcaagcagtggtcaggcgcaagggcactggaggctctcttgacagtcgccggggagctgagaggcccacctctccaggcagatacaggcaacctgctgaaaatggccaagaaagggggagtgacaggggtggaggccgcccacgcctggcggaatgccctcaccggagccccacttaacttctccggagacgcccgggggatcaggtcacgtg

SEQ ID NO: 375 - DNA, 1266 bp, artificial sequence
  Description of artificial sequence: synthetic polynucleotide
atgggcgatcctaaaaagaaacgtaaggtcatcgataaggagaccgccgctgccaagttcgagagacagcacatggacagcatcgatatcgccgacctgaggacactggggtactcccaacagcagcaagaaaagatcaagcccaaggtgcgcagcaccgtggcccagcaccacgaggccctggtcggccacgggttcactcacgcccatatcgtggctttgagtcagcatcccgccgccctcgggaccgtcgctgtgaagtatcaggatatgattgccgccctgcccgaggccactcacgaggctattgtgggcgtcggcaagcagtggtcaggcgcaagggcactggaggctctcttgacagtcgccggggagctgagaggcccacctctccaggcagatacaggcaacctgctgaaaatggccaagaaagggggagtgacaggggtggaggccgcccacgcctggcggaatgccctcaccggagccccacttaacttctccggagacgcccgggggatcaggtcacgtgcgtctcggagaagcaatgaggaaatcgtccatgtggccgctagaaggggcggagccggcaggattcggaaaatggtggcccctctcctggagcggcagggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 376 - DNA, 1248 bp, artificial sequence
  Description of artificial sequence: synthetic polynucleotide
atgggcgatcctaaaaagaaacgtaaggtcatcgattacccatacgatgttccagattacgctatcgatatcgccgacctgaggacactggggtactcccaacagcagcaagaaaagatcaagcccaaggtgcgcagcaccgtggcccagcaccacgaggccctggtcggccacgggttcactcacgcccatatcgtggctttgagtcagcatcccgccgccctcgggaccgtcgctgtgaagtatcaggatatgattgccgccctgcccgaggccactcacgaggctattgtgggcgtcggcaagcagtggtcaggcgcaagggcactggaggctctcttgacagtcgccggggagctgagaggcccacctctccaggcagatacaggcaacctgctgaaaatggccaagaaagggggagtgacaggggtggaggccgcccacgcctggcggaatgccctcaccggagccccacttaacttctccggagacgcccgggggatcaggtcacgtgcgtctcggagaagcaatgaggaaatcgtccatgtggccgctagaaggggcggagccggcaggattcggaaaatggtggcccctctcctggagcggcagggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 377 - DNA, 2790 bp, artificial sequence
  Description of artificial sequence: synthetic polynucleotide
atgggcgatcctaaaaagaaacgtaaggtcatcgattacccatacgatgttccagattacgctatcgatatcgccgacctgaggacactggggtactcccaacagcagcaagaaaagatcaagcccaaggtgcgcagcaccgtggcccagcaccacgaggccctggtcggccacgggttcactcacgcccatatcgtggctttgagtcagcatcccgccgccctcgggaccgtcgctgtgaagtatcaggatatgattgccgccctgcccgaggccactcacgaggctattgtgggcgtcggcaagcagtggtcaggcgcaagggcactggaggctctcttgacagtcgccggggagctgagaggcccacctctccaggcagatacaggcaacctgctgaaaatggccaagaaagggggagtgacaggggtggaggccgcccacgcctggcggaatgccctcaccggagccccacttaacttctcccagtcagatatagtcaagatagcaggaaacatcggtggcgctcaggcgttgcaagcggttctcgacctggagagcatgctgggcaagaggggcttttcacgcgacgacattgctaagatggctgggaacggcggcggggcccagacacttcaggcagtactggacctggagtcagcttttcgagagcgcggcttctcccaggcagacatagtgaaaatcgcaggcaacattggaggcgcacaagccctgtacagtgtgctggacgtggagccaactctggggaagcgggggttttctagagcagatattgtcaagattgcagggaacggtggcggtgcgcaagccctgcacactgtgctggatcttgaacctgcgcttggtaagagaggattctctcgcatcgacatcgtaaagattgcggccaacggaggcggggctcaggctctccacgccgtactggacttgggccccacgctccgagagtgtgggttcagccaggccaccatcgctaagatcgccggtaacgggggcggggcacaggcactccagatggtgcttgatctgggcccggccctgggcaaacgcgggttctcccaagctacgattgccaagatcgcaggaaatatcggcggagcgcaggctcttcagaccgtgctggaccttgagcctgccttgtgcgagcgcgggtttagtcaggccacaattgccaaaatggctggcaatattggaggtgcccaagctctccagactgtgcttgacctggaacccgccctccgaaaaagggattttcggcaggccgacatcatcaaaattgcgggcaacaacggtggagcgcaagccttgcaagcagttatcgaacacgggccaaccctgcggcagcatggctttaacctcgccgacatcgtgaagatggccggacacgacggtggcgcacaggccctccaggccgtcttggatctgaagccagttcttgatgagcacggatttagccagcctgacattgtgaaaatggccgggaatatcggtggagcacaagcactccaggctgtcctgagtctgggtccagctctgcgggaacggggcttctctcaacctgacatagtcaaaatcgctggtcatgatggcggtgctcaggcattgcaggccgttctcgatctggagctgaccctcgtggaacacgggttttcccaggccgatattgtgaagatagccgggaatgggggggggacacaggcgctgcatgccgtcctggatctggagaggatgctgggcgagagagggttctccagagctgacatcgtcaacgtcgccgggaacggagggggagcacaggctttgaaggctgtactggaacatgaggctaccctgaatgagaggggattcaaccttactgatattgttgaaatggctgctaatatcggaggcgctcaagctctcaaagccgtgctcgaacatggacccactctgcggcaacggggcctcagcttgattgacatcgttgagattgccggaaacggtgggggtgcccaggccctcaaagcagtcctgaagtacgggccagttctcatgcaggccgggagaagcaatgaggaaatcgtccatgtggccgctagaaggggcggagccggcaggattcggaaaatggtggcccctctcctggagcggcagggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 378 - DNA, 2808 bp, artificial sequence
  Description of artificial sequence: synthetic polynucleotide
atgggcgatcctaaaaagaaacgtaaggtcatcgataaggagaccgccgctgccaagttcgagagacagcacatggacagcatcgatatcgccgacctgaggacactggggtactcccaacagcagcaagaaaagatcaagcccaaggtgcgcagcaccgtggcccagcaccacgaggccctggtcggccacgggttcactcacgcccatatcgtggctttgagtcagcatcccgccgccctcgggaccgtcgctgtgaagtatcaggatatgattgccgccctgcccgaggccactcacgaggctattgtgggcgtcggcaagcagtggtcaggcgcaagggcactggaggctctcttgacagtcgccggggagctgagaggcccacctctccaggcagatacaggcaacctgctgaaaatggccaagaaagggggagtgacaggggtggaggccgcccacgcctggcggaatgccctcaccggagccccacttaacttctcccagtcagatatagtcaagatagcaggaaacaatggtggcgctcaggcgttgcaagcggttctcgacctggagagcatgctgggcaagaggggcttttcacgcgacgacattgctaagatggctgggaacggcggcggggcccagacacttcaggcagtactggacctggagtcagcttttcgagagcgcggcttctcccaggcagacatagtgaaaatcgcaggcaacggaggaggcgcacaagccctgtacagtgtgctggacgtggagccaactctggggaagcgggggttttctagagcagatattgtcaagattgcagggaacggtggcggtgcgcaagccctgcacactgtgctggatcttgaacctgcgcttggtaagagaggattctctcgcatcgacatcgtaaagattgcggccaacattggcggggctcaggctctccacgccgtactggacttgggccccacgctccgagagtgtgggttcagccaggccaccatcgctaagatcgccggtaacgggggcggggcacaggcactccagatggtgcttgatctgggcccggccctgggcaaacgcgggttctcccaagctacgattgccaagatcgcaggaaataacggcggagcgcaggctcttcagaccgtgctggaccttgagcctgccttgtgcgagcgcgggtttagtcaggccacaattgccaaaatggctggcaataacggaggtgcccaagctctccagactgtgcttgacctggaacccgccctccgaaaaagggattttcggcaggccgacatcatcaaaattgcgggcaacggcggtggagcgcaagccttgcaagcagttatcgaacacgggccaaccctgcggcagcatggctttaacctcgccgacatcgtgaagatggccggaaatggaggtggcgcacaggccctccaggccgtcttggatctgaagccagttcttgatgagcacggatttagccagcctgacattgtgaaaatggccgggaatatcggtggagcacaagcactccaggctgtcctgagtctgggtccagctctgcgggaacggggcttctctcaacctgacatagtcaaaatcgctggtcatgatggcggtgctcaggcattgcaggccgttctcgatctggagctgaccctcgtggaacacgggttttcccaggccgatattgtgaagatagccgggaatgggggggggacacaggcgctgcatgccgtcctggatctggagaggatgctgggcgagagagggttctccagagctgacatcgtcaacgtcgccgggaacggagggggagcacaggctttgaaggctgtactggaacatgaggctaccctgaatgagaggggattcaaccttactgatattgttgaaatggctgctaatatcggaggcgctcaagctctcaaagccgtgctcgaacatggacccactctgcggcaacggggcctcagcttgattgacatcgttgagattgccggaaacggtgggggtgcccaggccctcaaagcagtcctgaagtacgggccagttctcatgcaggccgggagaagcaatgaggaaatcgtccatgtggccgctagaaggggcggagccggcaggattcggaaaatggtggcccctctcctggagcggcagggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 379 - DNA, 396 bp, artificial sequence
  Description of artificial sequence: synthetic polynucleotide
ggcgcgccactagcgctctcgaggtcacgcgccaagccgccaccatgggcgatcctaaaaagaaacgtaaggtcatcgattacccatacgatgttccagattacgctatcgatatcgcctcaacagccttcgtggaccaggataagcagatggccaaccgcctgaatctctctcccctggagagaagtaagatcgagaaacagaacggcggcgccaccactctggcctttatcagcaacaagcagaacgaactcgcccagatcctgtccagggctgatattcttaagattgccagccaggggtgcgcagcccacgctctgcaagccgtcttggactgtgggccaatgttggggaagcggggattctccggagacgcccgggggatcaggtcacgtg

SEQ ID NO: 380 - DNA, 399 bp, artificial sequence
  Description of artificial sequence: synthetic polynucleotide
ggcgcgccactagcgctctcgaggtcacgcgccaagccgccaccatgggcgatcctaaaaagaaacgtaaggtcatcgattacccatacgatgttccagattacgctatcgatatcgcctcaacagccttcgtggaccaggataagcagatggccaaccgcctgaatctctctcccctggagagaagtaagatcgagaaacagtggtccggcgcccggactctggcctttatcagcaacaagcagaacgaactcgcccagatcggcctgtccagggctgatattcttaagattgccagcaagaggggcggggcccacgctctgcaagccgtcttggactgtgggccaatgttggggaagcggggattctccggagacgcccgggggatcaggtcacgtg

SEQ ID NO: 381 - DNA, 495 bp, artificial sequence
  Description of artificial sequence: synthetic polynucleotide
ggcgcgccactagcgctctcgaggtcacgcgccaagccgccaccatgggcgatcctaaaaagaaacgtaaggtcatcgattacccatacgatgttccagattacgctatcgatatcgcctcaacagccttcgtggaccaggataagcagatggccaaccgcctgaatctctctcccctggagagaagtaagatcgagaaacagtacggcggcgccaccactctggcctttatcagcaacaagcagaacgaactcgcccagatcctgtccagggctgatattcttaagattgccagctatgattgcgcagcccacgctctgcaagccgtcttggactgtgggccaatgttggggaagcggggactgtcccaggcagatattgtgaagatcgccagcaacgggggcggcgctcaggccctcaaagctgtgctggactgcgggcctatgctcggagagagggggttctccggagacgcccgggggatcaggtcacgtg

SEQ ID NO: 382 - DNA, 396 bp, artificial sequence
  Description of artificial sequence: synthetic polynucleotide
ggcgcgccactagcgctctcgaggtcacgcgccaagccgccaccatgggcgatcctaaaaagaaacgtaaggtcatcgattacccatacgatgttccagattacgctatcgatatcgcctcaacagccttcgtggaccaggataagcagatggccaaccgcctgaatctctctcccctggagagaagtaagatcgagaaacagtacggcggcgccaccactctggcctttatcagcaacaagcagaacgaactcgcccagatcctgtccagggctgatattcttaagattgccggcaacgggggcggggcccacgctctgcaagccgtcttggactgtgggccaatgttggggaagcggggattctccggagacgcccgggggatcaggtcacgtg

SEQ ID NO: 383 - DNA, 396 bp, artificial sequence
  Description of artificial sequence: synthetic polynucleotide
ggcgcgccactagcgctctcgaggtcacgcgccaagccgccaccatgggcgatcctaaaaagaaacgtaaggtcatcgattacccatacgatgttccagattacgctatcgatatcgcctcaacagccttcgtggaccaggataagcagatggccaaccgcctgaatctctctcccctggagagaagtaagatcgagaaacagtggggcggcgccaccactctggcctttatcagcaacaagcagaacgaactcgcccagatcctgtccagggctgatattcttaagattgccggcaacgggggcggggcccacgctctgcaagccgtcttggactgtgggccaatgttggggaagcggggattctccggagacgcccgggggatcaggtcacgtg

SEQ ID NO: 384 - DNA, 396 bp, artificial sequence
  Description of artificial sequence: synthetic polynucleotide
ggcgcgccactagcgctctcgaggtcacgcgccaagccgccaccatgggcgatcctaaaaagaaacgtaaggtcatcgattacccatacgatgttccagattacgctatcgatatcgcctcaacagccttcgtggaccaggataagcagatggccaaccgcctgaatctctctcccctggagagaagtaagatcgagaaacagtggtccggcgccaccactctggcctttatcagcaacaagcagaacgaactcgcccagatcctgtccagggctgatattcttaagattgccagcaagaggtgcgcagcccacgctctgcaagccgtcttggactgtgggccaatgttggggaagcggggattctccggagacgcccgggggatcaggtcacgtg

SEQ ID NO: 385 - DNA, 399 bp, artificial sequence
  Description of artificial sequence: synthetic polynucleotide
ggcgcgccactagcgctctcgaggtcacgcgccaagccgccaccatgggcgatcctaaaaagaaacgtaaggtcatcgattacccatacgatgttccagattacgctatcgatatcgcctcaacagccttcgtggaccaggataagcagatggccaaccgcctgaatctctctcccctggagagaagtaagatcgagaaacagacaggcggcgccaccactctggcctttatcagcaacaagcagaacgaactcgcccagatcggcctgtccagggctgatattcttaagattgccagctatgggtgcgcagcccacgctctgcaagccgtcttggactgtgggccaatgttggggaagcggggattctccggagacgcccgggggatcaggtcacgtg

SEQ ID NO: 386 - DNA, 396 bp, artificial sequence
  Description of artificial sequence: synthetic polynucleotide
ggcgcgccactagcgctctcgaggtcacgcgccaagccgccaccatgggcgatcctaaaaagaaacgtaaggtcatcgattacccatacgatgttccagattacgctatcgatatcgcctcaacagccttcgtggaccaggataagcagatggccaaccgcctgaatctctctcccctggagagaagtaagatcgagaaacagcggggcggcgccaccactctggcctttatcagcaacaagcagaacgaactcgcccagatcctgtccagggctgatattcttaagattgccaagagggggggcgcagcccacgctctgcaagccgtcttggactgtgggccaatgttggggaagcggggattctccggagacgcccgggggatcaggtcacgtg

SEQ ID NO: 387 - DNA, 399 bp, artificial sequence
  Description of artificial sequence: synthetic polynucleotide
ggcgcgccactagcgctctcgaggtcacgcgccaagccgccaccatgggcgatcctaaaaagaaacgtaaggtcatcgattacccatacgatgttccagattacgctatcgatatcgcctcaacagccttcgtggaccaggataagcagatggccaaccgcctgaatctctctcccctggagagaagtaagatcgagaaacagtacggcggcgccaccactctggcctttatcagcaacaagcagaacgaactcgcccagatcggcttctcccaggctgatattcttaagattgccggcaacgggggcggggcccacgctctgcaagccgtcttggactgtgggccaacattggggaagcggggattctccggagacgcccgggggatcaggtcacgtg

SEQ ID NO: 388 - DNA, 549 bp, artificial sequence
  Description of artificial sequence: synthetic polynucleotide
ggcgcgccactagcgctctcgaggtcacgcgccaagccgccaccatgggcgatcctaaaaagaaacgtaaggtcatcgattacccatacgatgttccagattacgctatcgatatcgccgccgatctgagaaccctggggtacagtcagcagcaacaggagaaaattaagcctaaggtgcgctctacagtggcccagcaccacgaggccctggtcgggcacggcttcacccatgctcatattgtggctctctcacagcaccccgccgccctgggcacagtcgccgtgaagtatcaggacatgatcgccgcactccccgaggccacacacgaggcaatcgtgggagtgggcaaacagtggtccggcgcccggactctggcctttatcagcaacaagcagaacgaactcgcccagatcctgtccagggctgatattcttaagattgccagcaagaggggcggggcccacgctctgcaagccgtcttggactgtgggccaatgttggggaagcggggattctccggagacgcccgggggatcaggtcacgtg

SEQ ID NO: 389 - DNA, 1086 bp, artificial sequence
  Description of artificial sequence: synthetic polynucleotide
atgggcgatcctaaaaagaaacgtaaggtcatcgattacccatacgatgttccagattacgctatcgatatcgcctcaacagccttcgtggaccaggataagcagatggccaaccgcctgaatctctctcccctggagagaagtaagatcgagaaacagaacggcggcgccaccactctggcctttatcagcaacaagcagaacgaactcgcccagatcctgtccagggctgatattcttaagattgccagccaggggtgcgcagcccacgctctgcaagccgtcttggactgtgggccaatgttggggaagcggggattctccggagacgcccgggggatcaggtcacgtgcgtctcggagaagcaatgaggaaatcgtccatgtggccgctagaaggggcggagccggcaggattcggaaaatggtggcccctctcctggagcggcagggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 390 - DNA, 1089 bp, artificial sequence
  Description of artificial sequence: synthetic polynucleotide
atgggcgatcctaaaaagaaacgtaaggtcatcgattacccatacgatgttccagattacgctatcgatatcgcctcaacagccttcgtggaccaggataagcagatggccaaccgcctgaatctctctcccctggagagaagtaagatcgagaaacagtggtccggcgcccggactctggcctttatcagcaacaagcagaacgaactcgcccagatcggcctgtccagggctgatattcttaagattgccagcaagaggggcggggcccacgctctgcaagccgtcttggactgtgggccaatgttggggaagcggggattctccggagacgcccgggggatcaggtcacgtgcgtctcggagaagcaatgaggaaatcgtccatgtggccgctagaaggggcggagccggcaggattcggaaaatggtggcccctctcctggagcggcagggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 391 - DNA, 1185 bp, artificial sequence
  Description of artificial sequence: synthetic polynucleotide
atgggcgatcctaaaaagaaacgtaaggtcatcgattacccatacgatgttccagattacgctatcgatatcgcctcaacagccttcgtggaccaggataagcagatggccaaccgcctgaatctctctcccctggagagaagtaagatcgagaaacagtacggcggcgccaccactctggcctttatcagcaacaagcagaacgaactcgcccagatcctgtccagggctgatattcttaagattgccagctatgattgcgcagcccacgctctgcaagccgtcttggactgtgggccaatgttggggaagcggggactgtcccaggcagatattgtgaagatcgccagcaacgggggcggcgctcaggccctcaaagctgtgctggactgcgggcctatgctcggagagagggggttctccggagacgcccgggggatcaggtcacgtgcgtctcggagaagcaatgaggaaatcgtccatgtggccgctagaaggggcggagccggcaggattcggaaaatggtggcccctctcctggagcggcagggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 392 - DNA, 1086 bp, artificial sequence
  Description of artificial sequence: synthetic polynucleotide
atgggcgatcctaaaaagaaacgtaaggtcatcgattacccatacgatgttccagattacgctatcgatatcgcctcaacagccttcgtggaccaggataagcagatggccaaccgcctgaatctctctcccctggagagaagtaagatcgagaaacagtacggcggcgccaccactctggcctttatcagcaacaagcagaacgaactcgcccagatcctgtccagggctgatattcttaagattgccggcaacgggggcggggcccacgctctgcaagccgtcttggactgtgggccaatgttggggaagcggggattctccggagacgcccgggggatcaggtcacgtgcgtctcggagaagcaatgaggaaatcgtccatgtggccgctagaaggggcggagccggcaggattcggaaaatggtggcccctctcctggagcggcagggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 393 - DNA, 1086 bp, artificial sequence
  Description of artificial sequence: synthetic polynucleotide
atgggcgatcctaaaaagaaacgtaaggtcatcgattacccatacgatgttccagattacgctatcgatatcgcctcaacagccttcgtggaccaggataagcagatggccaaccgcctgaatctctctcccctggagagaagtaagatcgagaaacagtggggcggcgccaccactctggcctttatcagcaacaagcagaacgaactcgcccagatcctgtccagggctgatattcttaagattgccggcaacgggggcggggcccacgctctgcaagccgtcttggactgtgggccaatgttggggaagcggggattctccggagacgcccgggggatcaggtcacgtgcgtctcggagaagcaatgaggaaatcgtccatgtggccgctagaaggggcggagccggcaggattcggaaaatggtggcccctctcctggagcggcagggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 394 - DNA, 1086 bp, artificial sequence
  Description of artificial sequence: synthetic polynucleotide
atgggcgatcctaaaaagaaacgtaaggtcatcgattacccatacgatgttccagattacgctatcgatatcgcctcaacagccttcgtggaccaggataagcagatggccaaccgcctgaatctctctcccctggagagaagtaagatcgagaaacagtggtccggcgccaccactctggcctttatcagcaacaagcagaacgaactcgcccagatcctgtccagggctgatattcttaagattgccagcaagaggtgcgcagcccacgctctgcaagccgtcttggactgtgggccaatgttggggaagcggggattctccggagacgcccgggggatcaggtcacgtgcgtctcggagaagcaatgaggaaatcgtccatgtggccgctagaaggggcggagccggcaggattcggaaaatggtggcccctctcctggagcggcagggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 395 - DNA, 1089 bp, artificial sequence
  Description of artificial sequence: synthetic polynucleotide
atgggcgatcctaaaaagaaacgtaaggtcatcgattacccatacgatgttccagattacgctatcgatatcgcctcaacagccttcgtggaccaggataagcagatggccaaccgcctgaatctctctcccctggagagaagtaagatcgagaaacagacaggcggcgccaccactctggcctttatcagcaacaagcagaacgaactcgcccagatcggcctgtccagggctgatattcttaagattgccagctatgggtgcgcagcccacgctctgcaagccgtcttggactgtgggccaatgttggggaagcggggattctccggagacgcccgggggatcaggtcacgtgcgtctcggagaagcaatgaggaaatcgtccatgtggccgctagaaggggcggagccggcaggattcggaaaatggtggcccctctcctggagcggcagggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 396 - DNA, 1086 bp, artificial sequence
  Description of artificial sequence: synthetic polynucleotide
atgggcgatcctaaaaagaaacgtaaggtcatcgattacccatacgatgttccagattacgctatcgatatcgcctcaacagccttcgtggaccaggataagcagatggccaaccgcctgaatctctctcccctggagagaagtaagatcgagaaacagcggggcggcgccaccactctggcctttatcagcaacaagcagaacgaactcgcccagatcctgtccagggctgatattcttaagattgccaagagggggggcgcagcccacgctctgcaagccgtcttggactgtgggccaatgttggggaagcggggattctccggagacgcccgggggatcaggtcacgtgcgtctcggagaagcaatgaggaaatcgtccatgtggccgctagaaggggcggagccggcaggattcggaaaatggtggcccctctcctggagcggcagggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 397 - DNA, 1089 bp, artificial sequence
  Description of artificial sequence: synthetic polynucleotide
atgggcgatcctaaaaagaaacgtaaggtcatcgattacccatacgatgttccagattacgctatcgatatcgcctcaacagccttcgtggaccaggataagcagatggccaaccgcctgaatctctctcccctggagagaagtaagatcgagaaacagtacggcggcgccaccactctggcctttatcagcaacaagcagaacgaactcgcccagatcggcttctcccaggctgatattcttaagattgccggcaacgggggcggggcccacgctctgcaagccgtcttggactgtgggccaacattggggaagcggggattctccggagacgcccgggggatcaggtcacgtgcgtctcggagaagcaatgaggaaatcgtccatgtggccgctagaaggggcggagccggcaggattcggaaaatggtggcccctctcctggagcggcagggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 398 - DNA, 1239 bp, artificial sequence
  Description of artificial sequence: synthetic polynucleotide
atgggcgatcctaaaaagaaacgtaaggtcatcgattacccatacgatgttccagattacgctatcgatatcgccgccgatctgagaaccctggggtacagtcagcagcaacaggagaaaattaagcctaaggtgcgctctacagtggcccagcaccacgaggccctggtcgggcacggcttcacccatgctcatattgtggctctctcacagcaccccgccgccctgggcacagtcgccgtgaagtatcaggacatgatcgccgcactccccgaggccacacacgaggcaatcgtgggagtgggcaaacagtggtccggcgcccggactctggcctttatcagcaacaagcagaacgaactcgcccagatcctgtccagggctgatattcttaagattgccagcaagaggggcggggcccacgctctgcaagccgtcttggactgtgggccaatgttggggaagcggggattctccggagacgcccgggggatcaggtcacgtgcgtctcggagaagcaatgaggaaatcgtccatgtggccgctagaaggggcggagccggcaggattcggaaaatggtggcccctctcctggagcggcagggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 399 - DNA, 2826 bp, artificial sequence
  Description of artificial sequence: synthetic polynucleotide
atgggcgatcctaaaaagaaacgtaaggtcatcgattacccatacgatgttccagattacgctatcgatatcgcctcaacagccttcgtggaccaggataagcagatggccaaccgcctgaatctctctcccctggagagaagtaagatcgagaaacagaacggcggcgccaccactctggcctttatcagcaacaagcagaacgaactcgcccagatcctgtccagggctgatattcttaagattgccagccaggggtgcgcagcccacgctctgcaagccgtcttggactgtgggccaatgttggggaagcggggattctcccagtcagatatagtcaagatagcaggacatgatggtggcgctcaggcgttgcaagcggttctcgacctggagagcatgctgggcaagaggggcttttcacgcgacgacattgctaagatggctgggaacggcggcggggcccagacacttcaggcagtactggacctggagtcagcttttcgagagcgcggcttctcccaggcagacatagtgaaaatcgcaggcaacatcggaggcgcacaagccctgtacagtgtgctggacgtggagccaactctggggaagcgggggttttctagagcagatattgtcaagattgcagggaacggtggcggtgcgcaagccctgcacactgtgctggatcttgaacctgcgcttggtaagagaggattctctcgcatcgacatcgtaaagattgcggccaacattggcggggctcaggctctccacgccgtactggacttgggccccacgctccgagagtgtgggttcagccaggccaccatcgctaagatcgccggaaacatcggcggggcacaggcactccagatggtgcttgatctgggcccggccctgggcaaacgcgggttctcccaagctacgattgccaagatcgcaggaaatatcggcggagcgcaggctcttcagaccgtgctggaccttgagcctgccttgtgcgagcgcgggtttagtcaggccacaattgccaaaatggctggccacgatggaggtgcccaagctctccagactgtgcttgacctggaacccgccctccgaaaaagggattttcggcaggccgacatcatcaaaattgccggccacgacggtggagcgcaagccttgcaagcagttatcgaacacgggccaaccctgcggcagcatggctttaacctcgccgacatcgtgaagatggccggaaatggaggtggcgcacaggccctccaggccgtcttggatctgaagccagttcttgatgagcacggatttagccagcctgacattgtgaaaatggccgggaatatcggtggagcacaagcactccaggctgtcctgagtctgggtccagctctgcgggaacggggcttctctcaacctgacatagtcaaaatcgctggtaatattggcggtgctcaggcattgcaggccgttctcgatctggagctgaccctcgtggaacacgggttttcccaggccgatattgtgaagatagccggacacgatggggggacacaggcgctgcatgccgtcctggatctggagaggatgctgggcgagagagggttctccagagctgacatcgtcaacgtcgccgggcatgatgggggagcacaggctttgaaggctgtactggaacatgaggctaccctgaatgagaggggattcagccgggctgatattgttaagatcgctggacatgacggaggcgctcaagctctcaaagccgtgctcgaacacgaggcaactctggatgagcggggcttcagcagggcagacatcgttaatgttgccggaaacggtgggggtgcccaggccctcaaagcagtcctggaacacgaagccacactcaacgagcgaggattcaatttgaccgacattgtggaaatggcagcccacgatggcggcgcccaggcgttgaaagccgtgttggaacatggccccacactcaggcagagagggctgtctcttatcgacatagtggaaattgcaggcaatggcgggggagcccaggctctgaaagcggtgctgaagtatggacccgtgcttatgcaggccgggagaagcaatgaggaaatcgtccatgtggccgctagaaggggcggagccggcaggattcggaaaatggtggcccctctcctggagcggcagggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 400 - DNA, 2829 bp, artificial sequence
  Description of artificial sequence: synthetic polynucleotide
atgggcgatcctaaaaagaaacgtaaggtcatcgattacccatacgatgttccagattacgctatcgatatcgcctcaacagccttcgtggaccaggataagcagatggccaaccgcctgaatctctctcccctggagagaagtaagatcgagaaacagtggtccggcgcccggactctggcctttatcagcaacaagcagaacgaactcgcccagatcggcctgtccagggctgatattcttaagattgccagcaagaggggcggggcccacgctctgcaagccgtcttggactgtgggccaatgttggggaagcggggattctcccagtcagatatagtcaagatagcaggacatgatggtggcgctcaggcgttgcaagcggttctcgacctggagagcatgctgggcaagaggggcttttcacgcgacgacattgctaagatggctgggaacggcggcggggcccagacacttcaggcagtactggacctggagtcagcttttcgagagcgcggcttctcccaggcagacatagtgaaaatcgcaggcaacatcggaggcgcacaagccctgtacagtgtgctggacgtggagccaactctggggaagcgggggttttctagagcagatattgtcaagattgcagggaacggtggcggtgcgcaagccctgcacactgtgctggatcttgaacctgcgcttggtaagagaggattctctcgcatcgacatcgtaaagattgcggccaacattggcggggctcaggctctccacgccgtactggacttgggccccacgctccgagagtgtgggttcagccaggccaccatcgctaagatcgccggaaacatcggcggggcacaggcactccagatggtgcttgatctgggcccggccctgggcaaacgcgggttctcccaagctacgattgccaagatcgcaggaaatatcggcggagcgcaggctcttcagaccgtgctggaccttgagcctgccttgtgcgagcgcgggtttagtcaggccacaattgccaaaatggctggccacgatggaggtgcccaagctctccagactgtgcttgacctggaacccgccctccgaaaaagggattttcggcaggccgacatcatcaaaattgccggccacgacggtggagcgcaagccttgcaagcagttatcgaacacgggccaaccctgcggcagcatggctttaacctcgccgacatcgtgaagatggccggaaatggaggtggcgcacaggccctccaggccgtcttggatctgaagccagttcttgatgagcacggatttagccagcctgacattgtgaaaatggccgggaatatcggtggagcacaagcactccaggctgtcctgagtctgggtccagctctgcgggaacggggcttctctcaacctgacatagtcaaaatcgctggtaatattggcggtgctcaggcattgcaggccgttctcgatctggagctgaccctcgtggaacacgggttttcccaggccgatattgtgaagatagccggacacgatggggggacacaggcgctgcatgccgtcctggatctggagaggatgctgggcgagagagggttctccagagctgacatcgtcaacgtcgccgggcatgatgggggagcacaggctttgaaggctgtactggaacatgaggctaccctgaatgagaggggattcagccgggctgatattgttaagatcgctggacatgacggaggcgctcaagctctcaaagccgtgctcgaacacgaggcaactctggatgagcggggcttcagcagggcagacatcgttaatgttgccggaaacggtgggggtgcccaggccctcaaagcagtcctggaacacgaagccacactcaacgagcgaggattcaatttgaccgacattgtggaaatggcagcccacgatggcggcgcccaggcgttgaaagccgtgttggaacatggccccacactcaggcagagagggctgtctcttatcgacatagtggaaattgcaggcaatggcgggggagcccaggctctgaaagcggtgctgaagtatggacccgtgcttatgcaggccgggagaagcaatgaggaaatcgtccatgtggccgctagaaggggcggagccggcaggattcggaaaatggtggcccctctcctggagcggcagggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 401 - DNA, 2925 bp, artificial sequence
  Description of artificial sequence: synthetic polynucleotide
atgggcgatcctaaaaagaaacgtaaggtcatcgattacccatacgatgttccagattacgctatcgatatcgcctcaacagccttcgtggaccaggataagcagatggccaaccgcctgaatctctctcccctggagagaagtaagatcgagaaacagtacggcggcgccaccactctggcctttatcagcaacaagcagaacgaactcgcccagatcctgtccagggctgatattcttaagattgccagctatgattgcgcagcccacgctctgcaagccgtcttggactgtgggccaatgttggggaagcggggactgtcccaggcagatattgtgaagatcgccagcaacgggggcggcgctcaggccctcaaagctgtgctggactgcgggcctatgctcggagagagggggttctcccagtcagatatagtcaagatagcaggacatgatggtggcgctcaggcgttgcaagcggttctcgacctggagagcatgctgggcaagaggggcttttcacgcgacgacattgctaagatggctgggaacggcggcggggcccagacacttcaggcagtactggacctggagtcagcttttcgagagcgcggcttctcccaggcagacatagtgaaaatcgcaggcaacatcggaggcgcacaagccctgtacagtgtgctggacgtggagccaactctggggaagcgggggttttctagagcagatattgtcaagattgcagggaacggtggcggtgcgcaagccctgcacactgtgctggatcttgaacctgcgcttggtaagagaggattctctcgcatcgacatcgtaaagattgcggccaacattggcggggctcaggctctccacgccgtactggacttgggccccacgctccgagagtgtgggttcagccaggccaccatcgctaagatcgccggaaacatcggcggggcacaggcactccagatggtgcttgatctgggcccggccctgggcaaacgcgggttctcccaagctacgattgccaagatcgcaggaaatatcggcggagcgcaggctcttcagaccgtgctggaccttgagcctgccttgtgcgagcgcgggtttagtcaggccacaattgccaaaatggctggccacgatggaggtgcccaagctctccagactgtgcttgacctggaacccgccctccgaaaaagggattttcggcaggccgacatcatcaaaattgccggccacgacggtggagcgcaagccttgcaagcagttatcgaacacgggccaaccctgcggcagcatggctttaacctcgccgacatcgtgaagatggccggaaatggaggtggcgcacaggccctccaggccgtcttggatctgaagccagttcttgatgagcacggatttagccagcctgacattgtgaaaatggccgggaatatcggtggagcacaagcactccaggctgtcctgagtctgggtccagctctgcgggaacggggcttctctcaacctgacatagtcaaaatcgctggtaatattggcggtgctcaggcattgcaggccgttctcgatctggagctgaccctcgtggaacacgggttttcccaggccgatattgtgaagatagccggacacgatggggggacacaggcgctgcatgccgtcctggatctggagaggatgctgggcgagagagggttctccagagctgacatcgtcaacgtcgccgggcatgatgggggagcacaggctttgaaggctgtactggaacatgaggctaccctgaatgagaggggattcagccgggctgatattgttaagatcgctggacatgacggaggcgctcaagctctcaaagccgtgctcgaacacgaggcaactctggatgagcggggcttcagcagggcagacatcgttaatgttgccggaaacggtgggggtgcccaggccctcaaagcagtcctggaacacgaagccacactcaacgagcgaggattcaatttgaccgacattgtggaaatggcagcccacgatggcggcgcccaggcgttgaaagccgtgttggaacatggccccacactcaggcagagagggctgtctcttatcgacatagtggaaattgcaggcaatggcgggggagcccaggctctgaaagcggtgctgaagtatggacccgtgcttatgcaggccgggagaagcaatgaggaaatcgtccatgtggccgctagaaggggcggagccggcaggattcggaaaatggtggcccctctcctggagcggcagggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 402 - DNA, 2826 bp, artificial sequence
  Description of artificial sequence: synthetic polynucleotide
atgggcgatcctaaaaagaaacgtaaggtcatcgattacccatacgatgttccagattacgctatcgatatcgcctcaacagccttcgtggaccaggataagcagatggccaaccgcctgaatctctctcccctggagagaagtaagatcgagaaacagtacggcggcgccaccactctggcctttatcagcaacaagcagaacgaactcgcccagatcctgtccagggctgatattcttaagattgccggcaacgggggcggggcccacgctctgcaagccgtcttggactgtgggccaatgttggggaagcggggattctcccagtcagatatagtcaagatagcaggacatgatggtggcgctcaggcgttgcaagcggttctcgacctggagagcatgctgggcaagaggggcttttcacgcgacgacattgctaagatggctgggaacggcggcggggcccagacacttcaggcagtactggacctggagtcagcttttcgagagcgcggcttctcccaggcagacatagtgaaaatcgcaggcaacatcggaggcgcacaagccctgtacagtgtgctggacgtggagccaactctggggaagcgggggttttctagagcagatattgtcaagattgcagggaacggtggcggtgcgcaagccctgcacactgtgctggatcttgaacctgcgcttggtaagagaggattctctcgcatcgacatcgtaaagattgcggccaacattggcggggctcaggctctccacgccgtactggacttgggccccacgctccgagagtgtgggttcagccaggccaccatcgctaagatcgccggaaacatcggcggggcacaggcactccagatggtgcttgatctgggcccggccctgggcaaacgcgggttctcccaagctacgattgccaagatcgcaggaaatatcggcggagcgcaggctcttcagaccgtgctggaccttgagcctgccttgtgcgagcgcgggtttagtcaggccacaattgccaaaatggctggccacgatggaggtgcccaagctctccagactgtgcttgacctggaacccgccctccgaaaaagggattttcggcaggccgacatcatcaaaattgccggccacgacggtggagcgcaagccttgcaagcagttatcgaacacgggccaaccctgcggcagcatggctttaacctcgccgacatcgtgaagatggccggaaatggaggtggcgcacaggccctccaggccgtcttggatctgaagccagttcttgatgagcacggatttagccagcctgacattgtgaaaatggccgggaatatcggtggagcacaagcactccaggctgtcctgagtctgggtccagctctgcgggaacggggcttctctcaacctgacatagtcaaaatcgctggtaatattggcggtgctcaggcattgcaggccgttctcgatctggagctgaccctcgtggaacacgggttttcccaggccgatattgtgaagatagccggacacgatggggggacacaggcgctgcatgccgtcctggatctggagaggatgctgggcgagagagggttctccagagctgacatcgtcaacgtcgccgggcatgatgggggagcacaggctttgaaggctgtactggaacatgaggctaccctgaatgagaggggattcagccgggctgatattgttaagatcgctggacatgacggaggcgctcaagctctcaaagccgtgctcgaacacgaggcaactctggatgagcggggcttcagcagggcagacatcgttaatgttgccggaaacggtgggggtgcccaggccctcaaagcagtcctggaacacgaagccacactcaacgagcgaggattcaatttgaccgacattgtggaaatggcagcccacgatggcggcgcccaggcgttgaaagccgtgttggaacatggccccacactcaggcagagagggctgtctcttatcgacatagtggaaattgcaggcaatggcgggggagcccaggctctgaaagcggtgctgaagtatggacccgtgcttatgcaggccgggagaagcaatgaggaaatcgtccatgtggccgctagaaggggcggagccggcaggattcggaaaatggtggcccctctcctggagcggcagggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 403 - DNA, 2826 bp, artificial sequence
  Description of artificial sequence: synthetic polynucleotide
atgggcgatcctaaaaagaaacgtaaggtcatcgattacccatacgatgttccagattacgctatcgatatcgcctcaacagccttcgtggaccaggataagcagatggccaaccgcctgaatctctctcccctggagagaagtaagatcgagaaacagtggggcggcgccaccactctggcctttatcagcaacaagcagaacgaactcgcccagatcctgtccagggctgatattcttaagattgccggcaacgggggcggggcccacgctctgcaagccgtcttggactgtgggccaatgttggggaagcggggattctcccagtcagatatagtcaagatagcaggacatgatggtggcgctcaggcgttgcaagcggttctcgacctggagagcatgctgggcaagaggggcttttcacgcgacgacattgctaagatggctgggaacggcggcggggcccagacacttcaggcagtactggacctggagtcagcttttcgagagcgcggcttctcccaggcagacatagtgaaaatcgcaggcaacatcggaggcgcacaagccctgtacagtgtgctggacgtggagccaactctggggaagcgggggttttctagagcagatattgtcaagattgcagggaacggtggcggtgcgcaagccctgcacactgtgctggatcttgaacctgcgcttggtaagagaggattctctcgcatcgacatcgtaaagattgcggccaacattggcggggctcaggctctccacgccgtactggacttgggccccacgctccgagagtgtgggttcagccaggccaccatcgctaagatcgccggaaacatcggcggggcacaggcactccagatggtgcttgatctgggcccggccctgggcaaacgcgggttctcccaagctacgattgccaagatcgcaggaaatatcggcggagcgcaggctcttcagaccgtgctggaccttgagcctgccttgtgcgagcgcgggtttagtcaggccacaattgccaaaatggctggccacgatggaggtgcccaagctctccagactgtgcttgacctggaacccgccctccgaaaaagggattttcggcaggccgacatcatcaaaattgccggccacgacggtggagcgcaagccttgcaagcagttatcgaacacgggccaaccctgcggcagcatggctttaacctcgccgacatcgtgaagatggccggaaatggaggtggcgcacaggccctccaggccgtcttggatctgaagccagttcttgatgagcacggatttagccagcctgacattgtgaaaatggccgggaatatcggtggagcacaagcactccaggctgtcctgagtctgggtccagctctgcgggaacggggcttctctcaacctgacatagtcaaaatcgctggtaatattggcggtgctcaggcattgcaggccgttctcgatctggagctgaccctcgtggaacacgggttttcccaggccgatattgtgaagatagccggacacgatggggggacacaggcgctgcatgccgtcctggatctggagaggatgctgggcgagagagggttctccagagctgacatcgtcaacgtcgccgggcatgatgggggagcacaggctttgaaggctgtactggaacatgaggctaccctgaatgagaggggattcagccgggctgatattgttaagatcgctggacatgacggaggcgctcaagctctcaaagccgtgctcgaacacgaggcaactctggatgagcggggcttcagcagggcagacatcgttaatgttgccggaaacggtgggggtgcccaggccctcaaagcagtcctggaacacgaagccacactcaacgagcgaggattcaatttgaccgacattgtggaaatggcagcccacgatggcggcgcccaggcgttgaaagccgtgttggaacatggccccacactcaggcagagagggctgtctcttatcgacatagtggaaattgcaggcaatggcgggggagcccaggctctgaaagcggtgctgaagtatggacccgtgcttatgcaggccgggagaagcaatgaggaaatcgtccatgtggccgctagaaggggcggagccggcaggattcggaaaatggtggcccctctcctggagcggcagggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 404 - DNA, 2826 bp, artificial sequence
  Description of artificial sequence: synthetic polynucleotide
atgggcgatcctaaaaagaaacgtaaggtcatcgattacccatacgatgttccagattacgctatcgatatcgcctcaacagccttcgtggaccaggataagcagatggccaaccgcctgaatctctctcccctggagagaagtaagatcgagaaacagtggtccggcgccaccactctggcctttatcagcaacaagcagaacgaactcgcccagatcctgtccagggctgatattcttaagattgccagcaagaggtgcgcagcccacgctctgcaagccgtcttggactgtgggccaatgttggggaagcggggattctcccagtcagatatagtcaagatagcaggacatgatggtggcgctcaggcgttgcaagcggttctcgacctggagagcatgctgggcaagaggggcttttcacgcgacgacattgctaagatggctgggaacggcggcggggcccagacacttcaggcagtactggacctggagtcagcttttcgagagcgcggcttctcccaggcagacatagtgaaaatcgcaggcaacatcggaggcgcacaagccctgtacagtgtgctggacgtggagccaactctggggaagcgggggttttctagagcagatattgtcaagattgcagggaacggtggcggtgcgcaagccctgcacactgtgctggatcttgaacctgcgcttggtaagagaggattctctcgcatcgacatcgtaaagattgcggccaacattggcggggctcaggctctccacgccgtactggacttgggccccacgctccgagagtgtgggttcagccaggccaccatcgctaagatcgccggaaacatcggcggggcacaggcactccagatggtgcttgatctgggcccggccctgggcaaacgcgggttctcccaagctacgattgccaagatcgcaggaaatatcggcggagcgcaggctcttcagaccgtgctggaccttgagcctgccttgtgcgagcgcgggtttagtcaggccacaattgccaaaatggctggccacgatggaggtgcccaagctctccagactgtgcttgacctggaacccgccctccgaaaaagggattttcggcaggccgacatcatcaaaattgccggccacgacggtggagcgcaagccttgcaagcagttatcgaacacgggccaaccctgcggcagcatggctttaacctcgccgacatcgtgaagatggccggaaatggaggtggcgcacaggccctccaggccgtcttggatctgaagccagttcttgatgagcacggatttagccagcctgacattgtgaaaatggccgggaatatcggtggagcacaagcactccaggctgtcctgagtctgggtccagctctgcgggaacggggcttctctcaacctgacatagtcaaaatcgctggtaatattggcggtgctcaggcattgcaggccgttctcgatctggagctgaccctcgtggaacacgggttttcccaggccgatattgtgaagatagccggacacgatggggggacacaggcgctgcatgccgtcctggatctggagaggatgctgggcgagagagggttctccagagctgacatcgtcaacgtcgccgggcatgatgggggagcacaggctttgaaggctgtactggaacatgaggctaccctgaatgagaggggattcagccgggctgatattgttaagatcgctggacatgacggaggcgctcaagctctcaaagccgtgctcgaacacgaggcaactctggatgagcggggcttcagcagggcagacatcgttaatgttgccggaaacggtgggggtgcccaggccctcaaagcagtcctggaacacgaagccacactcaacgagcgaggattcaatttgaccgacattgtggaaatggcagcccacgatggcggcgcccaggcgttgaaagccgtgttggaacatggccccacactcaggcagagagggctgtctcttatcgacatagtggaaattgcaggcaatggcgggggagcccaggctctgaaagcggtgctgaagtatggacccgtgcttatgcaggccgggagaagcaatgaggaaatcgtccatgtggccgctagaaggggcggagccggcaggattcggaaaatggtggcccctctcctggagcggcagggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 405 - DNA, 2829 bp, artificial sequence
  Description of artificial sequence: synthetic polynucleotide
atgggcgatcctaaaaagaaacgtaaggtcatcgattacccatacgatgttccagattacgctatcgatatcgcctcaacagccttcgtggaccaggataagcagatggccaaccgcctgaatctctctcccctggagagaagtaagatcgagaaacagacaggcggcgccaccactctggcctttatcagcaacaagcagaacgaactcgcccagatcggcctgtccagggctgatattcttaagattgccagctatgggtgcgcagcccacgctctgcaagccgtcttggactgtgggccaatgttggggaagcggggattctcccagtcagatatagtcaagatagcaggacatgatggtggcgctcaggcgttgcaagcggttctcgacctggagagcatgctgggcaagaggggcttttcacgcgacgacattgctaagatggctgggaacggcggcggggcccagacacttcaggcagtactggacctggagtcagcttttcgagagcgcggcttctcccaggcagacatagtgaaaatcgcaggcaacatcggaggcgcacaagccctgtacagtgtgctggacgtggagccaactctggggaagcgggggttttctagagcagatattgtcaagattgcagggaacggtggcggtgcgcaagccctgcacactgtgctggatcttgaacctgcgcttggtaagagaggattctctcgcatcgacatcgtaaagattgcggccaacattggcggggctcaggctctccacgccgtactggacttgggccccacgctccgagagtgtgggttcagccaggccaccatcgctaagatcgccggaaacatcggcggggcacaggcactccagatggtgcttgatctgggcccggccctgggcaaacgcgggttctcccaagctacgattgccaagatcgcaggaaatatcggcggagcgcaggctcttcagaccgtgctggaccttgagcctgccttgtgcgagcgcgggtttagtcaggccacaattgccaaaatggctggccacgatggaggtgcccaagctctccagactgtgcttgacctggaacccgccctccgaaaaagggattttcggcaggccgacatcatcaaaattgccggccacgacggtggagcgcaagccttgcaagcagttatcgaacacgggccaaccctgcggcagcatggctttaacctcgccgacatcgtgaagatggccggaaatggaggtggcgcacaggccctccaggccgtcttggatctgaagccagttcttgatgagcacggatttagccagcctgacattgtgaaaatggccgggaatatcggtggagcacaagcactccaggctgtcctgagtctgggtccagctctgcgggaacggggcttctctcaacctgacatagtcaaaatcgctggtaatattggcggtgctcaggcattgcaggccgttctcgatctggagctgaccctcgtggaacacgggttttcccaggccgatattgtgaagatagccggacacgatggggggacacaggcgctgcatgccgtcctggatctggagaggatgctgggcgagagagggttctccagagctgacatcgtcaacgtcgccgggcatgatgggggagcacaggctttgaaggctgtactggaacatgaggctaccctgaatgagaggggattcagccgggctgatattgttaagatcgctggacatgacggaggcgctcaagctctcaaagccgtgctcgaacacgaggcaactctggatgagcggggcttcagcagggcagacatcgttaatgttgccggaaacggtgggggtgcccaggccctcaaagcagtcctggaacacgaagccacactcaacgagcgaggattcaatttgaccgacattgtggaaatggcagcccacgatggcggcgcccaggcgttgaaagccgtgttggaacatggccccacactcaggcagagagggctgtctcttatcgacatagtggaaattgcaggcaatggcgggggagcccaggctctgaaagcggtgctgaagtatggacccgtgcttatgcaggccgggagaagcaatgaggaaatcgtccatgtggccgctagaaggggcggagccggcaggattcggaaaatggtggcccctctcctggagcggcagggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 406 - DNA, 2826 bp, artificial sequence
  Description of artificial sequence: synthetic polynucleotide
atgggcgatcctaaaaagaaacgtaaggtcatcgattacccatacgatgttccagattacgctatcgatatcgcctcaacagccttcgtggaccaggataagcagatggccaaccgcctgaatctctctcccctggagagaagtaagatcgagaaacagcggggcggcgccaccactctggcctttatcagcaacaagcagaacgaactcgcccagatcctgtccagggctgatattcttaagattgccaagagggggggcgcagcccacgctctgcaagccgtcttggactgtgggccaatgttggggaagcggggattctcccagtcagatatagtcaagatagcaggacatgatggtggcgctcaggcgttgcaagcggttctcgacctggagagcatgctgggcaagaggggcttttcacgcgacgacattgctaagatggctgggaacggcggcggggcccagacacttcaggcagtactggacctggagtcagcttttcgagagcgcggcttctcccaggcagacatagtgaaaatcgcaggcaacatcggaggcgcacaagccctgtacagtgtgctggacgtggagccaactctggggaagcgggggttttctagagcagatattgtcaagattgcagggaacggtggcggtgcgcaagccctgcacactgtgctggatcttgaacctgcgcttggtaagagaggattctctcgcatcgacatcgtaaagattgcggccaacattggcggggctcaggctctccacgccgtactggacttgggccccacgctccgagagtgtgggttcagccaggccaccatcgctaagatcgccggaaacatcggcggggcacaggcactccagatggtgcttgatctgggcccggccctgggcaaacgcgggttctcccaagctacgattgccaagatcgcaggaaatatcggcggagcgcaggctcttcagaccgtgctggaccttgagcctgccttgtgcgagcgcgggtttagtcaggccacaattgccaaaatggctggccacgatggaggtgcccaagctctccagactgtgcttgacctggaacccgccctccgaaaaagggattttcggcaggccgacatcatcaaaattgccggccacgacggtggagcgcaagccttgcaagcagttatcgaacacgggccaaccctgcggcagcatggctttaacctcgccgacatcgtgaagatggccggaaatggaggtggcgcacaggccctccaggccgtcttggatctgaagccagttcttgatgagcacggatttagccagcctgacattgtgaaaatggccgggaatatcggtggagcacaagcactccaggctgtcctgagtctgggtccagctctgcgggaacggggcttctctcaacctgacatagtcaaaatcgctggtaatattggcggtgctcaggcattgcaggccgttctcgatctggagctgaccctcgtggaacacgggttttcccaggccgatattgtgaagatagccggacacgatggggggacacaggcgctgcatgccgtcctggatctggagaggatgctgggcgagagagggttctccagagctgacatcgtcaacgtcgccgggcatgatgggggagcacaggctttgaaggctgtactggaacatgaggctaccctgaatgagaggggattcagccgggctgatattgttaagatcgctggacatgacggaggcgctcaagctctcaaagccgtgctcgaacacgaggcaactctggatgagcggggcttcagcagggcagacatcgttaatgttgccggaaacggtgggggtgcccaggccctcaaagcagtcctggaacacgaagccacactcaacgagcgaggattcaatttgaccgacattgtggaaatggcagcccacgatggcggcgcccaggcgttgaaagccgtgttggaacatggccccacactcaggcagagagggctgtctcttatcgacatagtggaaattgcaggcaatggcgggggagcccaggctctgaaagcggtgctgaagtatggacccgtgcttatgcaggccgggagaagcaatgaggaaatcgtccatgtggccgctagaaggggcggagccggcaggattcggaaaatggtggcccctctcctggagcggcagggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 407 - DNA, 2829 bp, artificial sequence
  Description of artificial sequence: synthetic polynucleotide
atgggcgatcctaaaaagaaacgtaaggtcatcgattacccatacgatgttccagattacgctatcgatatcgcctcaacagccttcgtggaccaggataagcagatggccaaccgcctgaatctctctcccctggagagaagtaagatcgagaaacagtacggcggcgccaccactctggcctttatcagcaacaagcagaacgaactcgcccagatcggcttctcccaggctgatattcttaagattgccggcaacgggggcggggcccacgctctgcaagccgtcttggactgtgggccaacattggggaagcggggattctcccagtcagatatagtcaagatagcaggacatgatggtggcgctcaggcgttgcaagcggttctcgacctggagagcatgctgggcaagaggggcttttcacgcgacgacattgctaagatggctgggaacggcggcggggcccagacacttcaggcagtactggacctggagtcagcttttcgagagcgcggcttctcccaggcagacatagtgaaaatcgcaggcaacatcggaggcgcacaagccctgtacagtgtgctggacgtggagccaactctggggaagcgggggttttctagagcagatattgtcaagattgcagggaacggtggcggtgcgcaagccctgcacactgtgctggatcttgaacctgcgcttggtaagagaggattctctcgcatcgacatcgtaaagattgcggccaacattggcggggctcaggctctccacgccgtactggacttgggccccacgctccgagagtgtgggttcagccaggccaccatcgctaagatcgccggaaacatcggcggggcacaggcactccagatggtgcttgatctgggcccggccctgggcaaacgcgggttctcccaagctacgattgccaagatcgcaggaaatatcggcggagcgcaggctcttcagaccgtgctggaccttgagcctgccttgtgcgagcgcgggtttagtcaggccacaattgccaaaatggctggccacgatggaggtgcccaagctctccagactgtgcttgacctggaacccgccctccgaaaaagggattttcggcaggccgacatcatcaaaattgccggccacgacggtggagcgcaagccttgcaagcagttatcgaacacgggccaaccctgcggcagcatggctttaacctcgccgacatcgtgaagatggccggaaatggaggtggcgcacaggccctccaggccgtcttggatctgaagccagttcttgatgagcacggatttagccagcctgacattgtgaaaatggccgggaatatcggtggagcacaagcactccaggctgtcctgagtctgggtccagctctgcgggaacggggcttctctcaacctgacatagtcaaaatcgctggtaatattggcggtgctcaggcattgcaggccgttctcgatctggagctgaccctcgtggaacacgggttttcccaggccgatattgtgaagatagccggacacgatggggggacacaggcgctgcatgccgtcctggatctggagaggatgctgggcgagagagggttctccagagctgacatcgtcaacgtcgccgggcatgatgggggagcacaggctttgaaggctgtactggaacatgaggctaccctgaatgagaggggattcagccgggctgatattgttaagatcgctggacatgacggaggcgctcaagctctcaaagccgtgctcgaacacgaggcaactctggatgagcggggcttcagcagggcagacatcgttaatgttgccggaaacggtgggggtgcccaggccctcaaagcagtcctggaacacgaagccacactcaacgagcgaggattcaatttgaccgacattgtggaaatggcagcccacgatggcggcgcccaggcgttgaaagccgtgttggaacatggccccacactcaggcagagagggctgtctcttatcgacatagtggaaattgcaggcaatggcgggggagcccaggctctgaaagcggtgctgaagtatggacccgtgcttatgcaggccgggagaagcaatgaggaaatcgtccatgtggccgctagaaggggcggagccggcaggattcggaaaatggtggcccctctcctggagcggcagggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 408 - DNA, 2979 bp, artificial sequence
  Description of artificial sequence: synthetic polynucleotide
atgggcgatcctaaaaagaaacgtaaggtcatcgattacccatacgatgttccagattacgctatcgatatcgccgccgatctgagaaccctggggtacagtcagcagcaacaggagaaaattaagcctaaggtgcgctctacagtggcccagcaccacgaggccctggtcgggcacggcttcacccatgctcatattgtggctctctcacagcaccccgccgccctgggcacagtcgccgtgaagtatcaggacatgatcgccgcactccccgaggccacacacgaggcaatcgtgggagtgggcaaacagtggtccggcgcccggactctggcctttatcagcaacaagcagaacgaactcgcccagatcctgtccagggctgatattcttaagattgccagcaagaggggcggggcccacgctctgcaagccgtcttggactgtgggccaatgttggggaagcggggattctcccagtcagatatagtcaagatagcaggacatgatggtggcgctcaggcgttgcaagcggttctcgacctggagagcatgctgggcaagaggggcttttcacgcgacgacattgctaagatggctgggaacggcggcggggcccagacacttcaggcagtactggacctggagtcagcttttcgagagcgcggcttctcccaggcagacatagtgaaaatcgcaggcaacatcggaggcgcacaagccctgtacagtgtgctggacgtggagccaactctggggaagcgggggttttctagagcagatattgtcaagattgcagggaacggtggcggtgcgcaagccctgcacactgtgctggatcttgaacctgcgcttggtaagagaggattctctcgcatcgacatcgtaaagattgcggccaacattggcggggctcaggctctccacgccgtactggacttgggccccacgctccgagagtgtgggttcagccaggccaccatcgctaagatcgccggaaacatcggcggggcacaggcactccagatggtgcttgatctgggcccggccctgggcaaacgcgggttctcccaagctacgattgccaagatcgcaggaaatatcggcggagcgcaggctcttcagaccgtgctggaccttgagcctgccttgtgcgagcgcgggtttagtcaggccacaattgccaaaatggctggccacgatggaggtgcccaagctctccagactgtgcttgacctggaacccgccctccgaaaaagggattttcggcaggccgacatcatcaaaattgccggccacgacggtggagcgcaagccttgcaagcagttatcgaacacgggccaaccctgcggcagcatggctttaacctcgccgacatcgtgaagatggccggaaatggaggtggcgcacaggccctccaggccgtcttggatctgaagccagttcttgatgagcacggatttagccagcctgacattgtgaaaatggccgggaatatcggtggagcacaagcactccaggctgtcctgagtctgggtccagctctgcgggaacggggcttctctcaacctgacatagtcaaaatcgctggtaatattggcggtgctcaggcattgcaggccgttctcgatctggagctgaccctcgtggaacacgggttttcccaggccgatattgtgaagatagccggacacgatggggggacacaggcgctgcatgccgtcctggatctggagaggatgctgggcgagagagggttctccagagctgacatcgtcaacgtcgccgggcatgatgggggagcacaggctttgaaggctgtactggaacatgaggctaccctgaatgagaggggattcagccgggctgatattgttaagatcgctggacatgacggaggcgctcaagctctcaaagccgtgctcgaacacgaggcaactctggatgagcggggcttcagcagggcagacatcgttaatgttgccggaaacggtgggggtgcccaggccctcaaagcagtcctggaacacgaagccacactcaacgagcgaggattcaatttgaccgacattgtggaaatggcagcccacgatggcggcgcccaggcgttgaaagccgtgttggaacatggccccacactcaggcagagagggctgtctcttatcgacatagtggaaattgcaggcaatggcgggggagcccaggctctgaaagcggtgctgaagtatggacccgtgcttatgcaggccgggagaagcaatgaggaaatcgtccatgtggccgctagaaggggcggagccggcaggattcggaaaatggtggcccctctcctggagcggcagggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 409 - DNA, 2628 bp, artificial sequence
  Description of artificial sequence: synthetic polynucleotide
atgggcgatcctaaaaagaaacgtaaggtcatcgattacccatacgatgttccagattacgctatcgatatcgcctcaaccgccttcgtggaccaggataagcaaatggccaaccgcttgaacctgagtcccctggagaggtctaagattgagaagcagtacggcggggccacaactctggcctttatctccaacaagcagaacgagctggcccagatccttagccgggcagacatcttgaagattgcctcctatgattgtgctgcacacgccctccaggctgtcctcgattgcgggccaatgctggggaagagaggattctcccagagtgatattgtcaaaattgcaggacatgacggaggagcccaagctctgcaagccgtgcttgacctggagagcatgttgggcaaaagaggcttttccagggacgatattgccaaaatggccgggaacggaggaggcgctcagacattgcaggctgtcctcgacttggagagcgcttttagggagcggggcttctcccaggccgacattgtgaaaattgccgggcacgatgggggagcccaggcactgtactccgtcctcgacgtggaacctacccttggaaagaggggctttagccgggctgatattgtgaagatcgcaggaaacgggggcggcgctcaagcactgcataccgtgctcgatctggagcccgccctcggaaaaagagggttctctagaatcgacatcgtgaaaatcgccgccaacggcggaggcgcccaggccctgcacgccgtgctggatttggggccaacccttcgcgaatgcggcttttcacaggctaccatcgcaaagatcgctgggcacgacggcggggcccaggctttgcagatggtcctggacttgggcccagccctgggaaagagaggcttcagccaggccactattgccaagatcgccggcaacaacggcggcgcacaggctctccagacagtgttggacctcgaacccgcactttgcgagagggggttttcccaggccaccatcgccaagatggctggccacgatggcggagcacaagccctgcaaactgtgctcgatttggagccagccctgcggaagagagacttccggcaggctgacattattaagattgcaggcaatggagggggagcccaagcacttcaggcagtcattgaacatggacctacattgcgccagcatggattcaacctcgccgacattgtcaagatggctggccatgacgggggcgcccaggccctgcaagccgtcctggatctgaagcctgtgttggacgagcacggcttcagccagccagacattgtgaagatggccggaaatggaggcggggcacaggctcttcaggccgtgctttccttggggcccgctctccgggagcggggctttagccagcctgatattgtgaaaatcgcaggccatgatggcggagcacaggccctccaggcagtgctggatctcgaactcaccttggtggagcatgggttcagtcaggccgatattgtcaaaattgctggaaacatcggcggaacccaagctctccacgctgtgctcgacctggaaaggatgctcggggagagagggtttagcagggctgacatcgtgaacgtggccggcaacatcggaggggcccaagccctgaaggctgtgctggagcacgaagccactctgaacgagcgcgggttcaacctgaccgacatcgtggagatggccgcccacgacggaggcgctcaggcactgaaggccgtcttggagcacgggcctacactcagacagcggggcctgtccttgattgacattgtcgagattgcaggcaatgggggaggagcccaggctctcaaggctgtgttgaagtacggccccgtcctcatgcaggccgggagaagcaatgaggaaatcgtccatgtggccgctagaaggggcggagccggcaggattcggaaaatggtggcccctctcctggagcggcagggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 410 - DNA, 2646 bp, artificial sequence
  Description of artificial sequence: synthetic polynucleotide
atgggcgatcctaaaaagaaacgtaaggtcatcgataaggagaccgccgctgccaagttcgagagacagcacatggacagcatcgatatcgcctcaaccgccttcgtggaccaggataagcaaatggccaaccgcttgaacctgagtcccctggagaggtctaagattgagaagcagtacggcggggccacaactctggcctttatctccaacaagcagaacgagctggcccagatccttagccgggcagacatcttgaagattgcctcctatgattgtgctgcacacgccctccaggctgtcctcgattgcgggccaatgctggggaagagaggattctcccagagtgatattgtcaaaattgcaggaaataacggaggagcccaagctctgcaagccgtgcttgacctggagagcatgttgggcaaaagaggcttttccagggacgatattgccaaaatggccgggaacaatggaggcgctcagacattgcaggctgtcctcgacttggagagcgcttttagggagcggggcttctcccaggccgacattgtgaaaattgccgggaacaacgggggagcccaggcactgtactccgtcctcgacgtggaacctacccttggaaagaggggctttagccgggctgatattgtgaagatcgcaggaaacattggcggcgctcaagcactgcataccgtgctcgatctggagcccgccctcggaaaaagagggttctctagaatcgacatcgtgaaaatcgccgccaacattggaggcgcccaggccctgcacgccgtgctggatttggggccaacccttcgcgaatgcggcttttcacaggctaccatcgcaaagatcgctgggaataatggcggggcccaggctttgcagatggtcctggacttgggcccagccctgggaaagagaggcttcagccaggccactattgccaagatcgccggcaacatcggcggcgcacaggctctccagacagtgttggacctcgaacccgcactttgcgagagggggttttcccaggccaccatcgccaagatggctggcaacaacggcggagcacaagccctgcaaactgtgctcgatttggagccagccctgcggaagagagacttccggcaggctgacattattaagattgcaggcaatattgggggagcccaagcacttcaggcagtcattgaacatggacctacattgcgccagcatggattcaacctcgccgacattgtcaagatggctggcaatatcgggggcgcccaggccctgcaagccgtcctggatctgaagcctgtgttggacgagcacggcttcagccagccagacattgtgaagatggccggaaataacggcggggcacaggctcttcaggccgtgctttccttggggcccgctctccgggagcggggctttagccagcctgatattgtgaaaatcgcaggcaacgggggcggagcacaggccctccaggcagtgctggatctcgaactcaccttggtggagcatgggttcagtcaggccgatattgtcaaaattgctggaaacattggcggaacccaagctctccacgctgtgctcgacctggaaaggatgctcggggagagagggtttagcagggctgacatcgtgaacgtggccggcaacaatggaggggcccaagccctgaaggctgtgctggagcacgaagccactctgaacgagcgcgggttcaacctgaccgacatcgtggagatggccgccaacattggaggcgctcaggcactgaaggccgtcttggagcacgggcctacactcagacagcggggcctgtccttgattgacattgtcgagattgcaggcaatgggggaggagcccaggctctcaaggctgtgttgaagtacggccccgtcctcatgcaggccgggagaagcaatgaggaaatcgtccatgtggccgctagaaggggcggagccggcaggattcggaaaatggtggcccctctcctggagcggcagggcagatctggctcggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 411 - DNA, 4722 bp, artificial sequence
  Description of artificial sequence: synthetic polynucleotide
ggaattgtgagcggataacaatttcacacaggaaacagctatgaccatgattacgccaagcgcgcaattaaccctcactaaagggaacaaaagctgggtactcgtacggtccccagatttgccttttcaatttcagaaagaatgctaacccacagatggttagagaggcttacgcagcaggtctcatcaagacgatctacccgagcaataatctccaggaaatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccctttcctctatataaggaagttcatttcatttggagagaacacgggggactctagaatggtgagtaaaggagaagaacttttcactggagttgtcccaattcttgttgaattagatggtgatgttaatgggcacaaattttctgtcagtggagagggtgaaggtgatgcaacatacggaaaacttacccttaaatttatttgcactactggaaaactacctgttccatggccaaccctggtcaccaccctgacctacggcgtgcagtgcttctcccgttaccctgatcatatgaagcggcacgacttcttcaagagcgccatgcctgagggatacgtgcaggagaggaccatcttcttcaaggacgacgggaactacaagacacgtgctgaagtcaagtttgagggagacaccctcgtcaacaggatcgagcttaagggaatcgatttcaaggaggacggaaacatcctcggccacaagttggaatacaactacaactcccacaacgtatacatcatggccgacaagcaaaagaacggcatcaaagccaacttcaagacccgccacaacatcgaagacggcggcgtgcaactcgctgatcattatcaacaaaatactccaattggcgatggccctgtccttttaccagacaaccattacctgtccacacaatctgccctttcgaaagatcccaacgaaaagagagaccacatggtccttcttgagtttgtaacagctgctgggattacacatggcatggatgaactatacaaataaagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgtgggcccagctccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaaatcaaaagaatagaccgagataggggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgt

SEQ ID NO: 412 - protein, 55 aa, artificial sequence
  Description of artificial sequence: synthetic polypeptide
KQYGGATTLAFISNKQNELAQILSRADILKIASYDCAAHALQAVLDCGPMLGKRG

SEQ ID NO: 413 - protein, 246 aa, artificial sequence
  Description of artificial sequence: synthetic polypeptide
MAKSGIYQIKNTLNNKVYVGSAKDFEKRWKRHFKDLEKGCHSSIKLQRSFNKHGNVFECSILEEIPYEKDLIIERENFWIKELNSKINGYNIADATFGDTCSTHPLKEEIIKKRSETVKAKMLKLGPDGRKALYSKPGSKNGRWNPETHKFCKCGVRIQTSAYTCSKCRNRSGENNSFFNHKHSDITKSKISEKMKGKKPSNIKKISCDGVIFDCAADAARHFKISSGLVTYRVKSDKWNWFYINA

SEQ ID NO: 414 - DNA, 498 bp, artificial sequence; identical to SEQ ID NO: 121
  Description of artificial sequence: synthetic polynucleotide

SEQ ID NO: 415 - DNA, 3032 bp, artificial sequence
  Description of artificial sequence: synthetic polynucleotide
gggcggagcctatggaaaaacgccagcaacgcggcctttttacggttcctggccttttgctggccttttgctcacatggtctttcctgcgttatcccctgattctgtggataaccgtattaccgcctttgagtgagctgataccgctcgccgcagccgaacgaccgagcgcagcgagtcagtgagcgaggaagcggagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgtcaattaaccctcactaaagggaacaaaagctgttaattaagcgcgccacacgcaaacacaaatacacagcggccttgccaccatggcaaacaccggtggatcctccggaagatcttcggccgactgataagtcgaccaccaccaccaccaccactgataagagctcctcgagcctgcagcagctgaagctttggacttctggcgcgcccaattcgccctatagtgagtcgtattacgtcgcgctcactggccgtcgttttacaacgtcgtgactgggaaaaccctggcgttacccaacttaatcgccttgcagcacatccccctttcgccagctggcgtaatagcgaagaggcccgcaccgaaacgcccttcccaacagttgcgcagcctgaatggcgaatgggagcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttggcctgtagtgggccatagccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggg

SEQ ID NO: 416 - protein, 184 aa, artificial sequence
  Description of artificial sequence: synthetic polypeptide
MAKSGIYQIKNTLNNKVYVGSAKDFEKRWKRHFKDLEKGCHSSIKLQRSFNKHGNVFECSILEEIPYEKDLIIERENFWIKELNSKINGYNIADATFGDTCSTHPLKEEIIKKRSETVKAKMLKLGPDGRKALYSKPGSKNGRWNPETHKFCKCGVRIQTSAYTCSKCRNRSGENNSFFNHKHS

SEQ ID NO: 417 - protein, 138 aa, artificial sequence
  Description of artificial sequence: synthetic polypeptide
MAKSGIYQIKNTLNNKVYVGSAKDFEKRWKRHFKDLEKGCHSSIKLQRSFNKHGNVFECSILEEIPYEKDLIIERENFWIKELNSKINGYNIADATFGDTCSTHPLKEEIIKKRSETVKAKMLKLGPDGRKALYSKPG

SEQ ID NO: 418 - protein, 354 aa, artificial sequence
  Description of artificial sequence: synthetic polypeptide
MAKSGIYQIKNTLNNKVYVGSAKDFEKRWKRHFKDLEKGCHSSIKLQRSFNKHGNVFECSILEEIPYEKDLIIERENFWIKELNSKINGYNIADATFGDTCSTHPLKEEIIKKRSETVKAKMLKLGPDGRKALYSKPGSKNGRWNPETHKFCKCGVRIQTSAYTCSKCRNRSGENNSFFNHKHSQGPSGNTKYNKEFLLYLAGFVDGNGSIIAQIKPNQSYKFKHQLSLTFQVTQKTQRRWFLDKLVDEIGVGYVRDRGSVSDYILSEIKPLHNFLTQLQPFLKLKQKQANLVLKIIEQLPSAKESPDKFLEVCTWVDQIAALNDSKTRKTTSETVRAVLDSLSEKKKSSPAAD

SEQ ID NO: 419 - DNA, 9363 bp, artificial sequence
  Description of artificial sequence: synthetic polynucleotide
ttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtccgatcaaaaatcatcgcttcgctgattaattaccccagaaataaggctaaaaaactaatcgcattatcatcctatggttgttaatttgattcgttcatttgaaggtttgtggggccaggttactgccaatttttcctcttcataaccataaaagctagtattgtagaatctttattgttcggagcagtgcggcgcgaggcacatctgcgtttcaggaacgcgaccggtgaagacgaggacgcacggaggagagtcttccttcggagggctgtcacccgctcggcggcttctaatccgtacttcaatatagcaatgagcagttaagcgtattactgaaagttccaaagagaaggtttttttaggctaatcgacctcgagcagatccgccaggcgtgtatatagcgtggatggccaggcaactttagtgctgacacatacaggcatatatatatgtgtgcgacgacacatgatcatatggcatgcatgtgctctgtatgtatataaaactcttgttttcttcttttctctaaatattctttccttatacattaggtcctttgtagcataaattactatacttctatagacacgcaaacacaaatacacagcggccttgccaccatggccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaactggggcctgatggcagaaaggcactctactctaagccaggtagcaaaaatggaaggtggaaccctgagacccacaagttctgcaaatgtggggtgagaatacagacatcagcctacacttgcagcaagtgtaggaacagatcaggagagaataactcctttttcaaccacaagcattctcaaggtccatctggcaataccaaatataacaaagagttcctgctgtacctggccggctttgtggacggtaacggtagcatcatcgctcagattaaaccaaaccagtcttataagtttaaacatcagctaagcttgacctttcaggtgactcaaaagacccagcgccgttggtttctggacaaactagtggatgaaattggcgttggttacgtacgtgatcgcggatccgtttccgattacattttaagcgaaatcaagccgctgcacaacttcctgactcaactgcagccgtttctgaaactgaaacagaaacaggcaaacctggttctgaaaattatcgaacagctgccgtctgcaaaagaatccccggacaaattcctggaagtttgtacctgggtggatcagattgcagctctgaacgattctaagacgcgtaaaaccacttctgaaaccgttcgtgctgtgctggacagcctgagcgagaagaagaaatcctccccggcggccgactgataactcgagcgatcctctagacgagctcctcgagcctgcagcagctgaagctttggacttcttcgccagaggtttggtcaagtctccaatcaaggttgtcggcttgtctaccttgccagaaatttacgaaaagatggaaaagggtcaaatcgttggtagatacgttgttgacacttctaaataagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcagatctattacattatgggtggtatgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaatgatgataataatatttatagaattgtgtagaattgcagattcccttttatggattcctaaatcctcgaggagaacttctagtatatctacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagagccgcggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatatttcaaggatataccattctaatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtgggtggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatgttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggtcaaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccacggaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatgtaaaggaatacaggtaagcaaattgatactaatggctcaacgtgataaggaaaaagaattgcactttaacattaatattgacaaggaggagggcaccacacaaaaagttaggtgtaacagaaaatcatgaaactatgattcctaatttatatattggaggattttctctaaaaaaaaaaaaatacaacaaataaaaaacactcaatgacctgaccatttgatggagtttaagtcaataccttcttgaaccatttcccataatggtgaaagttccctcaagaattttactctgtcagaaacggccttaacgacgtagtcgacctcctcttcagtactaaatctaccaataccaaatctgatggaagaatgggctaatgcatcatccttacccagcgcatgtaaaacataagaaggttctagggaagcagatgtacaggctgaacccgaggataatgcgatatcccttagtgccatcaataaagattctccttccacgtaggcgaaagaaacgttaacacaccctggataacgatgatctggagatccgttcaacgtggtatgttcagcggataatagacctttgactaatttatcggatagtcttttgatgtgagcttggtcgttgtcaaattctttcttcatcaatctcgcagcttcaccaaatcccgctaccaatgggggggccaaagtaccagatctgctgcattaatgaatcggccaacgcgcggggagaggcggtttgcgtattgggcgctcttccgcttcctcgctcactgactcgctgcgctcggtcgttcggctgcggcgagcggtatcagcatcgatgaattccacggactatagactatactagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagtgcgaagtagtgatcaggtattgctgttatctgatgagtatacgttgtcctggccacggcagaagcacgcttatcgctccaatttcccacaacattagtcaactccgttaggcccttcattgaaagaaatgaggtcatcaaatgtcttccaatgtgagattttgggccattttttatagcaaagattgaataaggcgcatttttcttcaaagctttattgtacgatctgactaagttatcttttaataattggtattcctgtttattgcttgaagaattgccggtcctatttactcgttttaggactggttcagaattcatcgatgctcactcaaaggtcggtaatacggttatccacagaatcaggggataacgcaggaaagaacatgtgagcaaaaggccagcaaaaggccaggaaccgtaaaaaggccgcgttgctggcgttt

SEQ ID NO: 420 - DNA, 1782 bp, artificial sequence
  Description of artificial sequence: synthetic polynucleotide
ttctcccagtcagatatagtcaagatagcaggacatgatggtggcgctcaggcgttgcaagcggttctcgacctggagagcatgctgggcaagaggggcttttcacgcgacgacattgctaagatggctgggaacggcggcggggcccagacacttcaggcagtactggacctggagtcagcttttcgagagcgcggcttctcccaggcagacatagtgaaaatcgcaggcaacatcggaggcgcacaagccctgtacagtgtgctggacgtggagccaactctggggaagcgggggttttctagagcagatattgtcaagattgcagggaacggtggcggtgcgcaagccctgcacactgtgctggatcttgaacctgcgcttggtaagagaggattctctcgcatcgacatcgtaaagattgcggccaacattggcggggctcaggctctccacgccgtactggacttgggccccacgctccgagagtgtgggttcagccaggccaccatcgctaagatcgccggaaacatcggcggggcacaggcactccagatggtgcttgatctgggcccggccctgggcaaacgcgggttctcccaagctacgattgccaagatcgcaggaaatatcggcggagcgcaggctcttcagaccgtgctggaccttgagcctgccttgtgcgagcgcgggtttagtcaggccacaattgccaaaatggctggccacgatggaggtgcccaagctctccagactgtgcttgacctggaacccgccctccgaaaaagggattttcggcaggccgacatcatcaaaattgccggccacgacggtggagcgcaagccttgcaagcagttatcgaacacgggccaaccctgcggcagcatggctttaacctcgccgacatcgtgaagatggccggaaatggaggtggcgcacaggccctccaggccgtcttggatctgaagccagttcttgatgagcacggatttagccagcctgacattgtgaaaatggccgggaatatcggtggagcacaagcactccaggctgtcctgagtctgggtccagctctgcgggaacggggcttctctcaacctgacatagtcaaaatcgctggtaatattggcggtgctcaggcattgcaggccgttctcgatctggagctgaccctcgtggaacacgggttttcccaggccgatattgtgaagatagccggacacgatggggggacacaggcgctgcatgccgtcctggatctggagaggatgctgggcgagagagggttctccagagctgacatcgtcaacgtcgccgggcatgatgggggagcacaggctttgaaggctgtactggaacatgaggctaccctgaatgagaggggattcagccgggctgatattgttaagatcgctggacatgacggaggcgctcaagctctcaaagccgtgctcgaacacgaggcaactctggatgagcggggcttcagcagggcagacatcgttaatgttgccggaaacggtgggggtgcccaggccctcaaagcagtcctggaacacgaagccacactcaacgagcgaggattcaatttgaccgacattgtggaaatggcagcccacgatggcggcgcccaggcgttgaaagccgtgttggaacatggccccacactcaggcagagagggctgtctcttatcgacatagtggaaattgcaggcaatggcgggggagcccaggctctgaaagcggtgctgaagtatggacccgtgcttatgcaggccggg

SEQ ID NO: 421 - protein, 897 aa, artificial sequence
  Description of artificial sequence: synthetic polypeptide
MAKSGIYQIKNTLNNKVYVGSAKDFEKRWKRHFKDLEKGCHSSIKLQRSFNKHGNVFECSILEEIPYEKDLIIERENFWIKELNSKINGYNIADATFGDTCSTHPLKEEIIKKRSETVKAKMLKLGPDGRKALYSKPGSKNGRWNPETHKFCKCGVRIQTSAYTCSKCRNRSGENNSFFNHKHSQGPSGSTAFVDQDKQMANRLNLSPLERSKIEKQYGGATTLAFISNKQNELAQILSRADILKIASYDCAAHALQAVLDCGPMLGKRGFSQSDIVKIAGHDGGAQALQAVLDLESMLGKRGFSRDDIAKMAGNGGGAQTLQAVLDLESAFRERGFSQADIVKIAGNIGGAQALYSVLDVEPTLGKRGFSRADIVKIAGNGGGAQALHTVLDLEPALGKRGFSRIDIVKIAANIGGAQALHAVLDLGPTLRECGFSQATIAKIAGNIGGAQALQMVLDLGPALGKRGFSQATIAKIAGNIGGAQALQTVLDLEPALCERGFSQATIAKMAGHDGGAQALQTVLDLEPALRKRDFRQADIIKIAGHDGGAQALQAVIEHGPTLRQHGFNLADIVKMAGNGGGAQALQAVLDLKPVLDEHGFSQPDIVKMAGNIGGAQALQAVLSLGPALRERGFSQPDIVKIAGNIGGAQALQAVLDLELTLVEHGFSQADIVKIAGHDGGTQALHAVLDLERMLGERGFSRADIVNVAGHDGGAQALKAVLEHEATLNERGFSRADIVKIAGHDGGAQALKAVLEHEATLDERGFSRADIVNVAGNGGGAQALKAVLEHEATLNERGFNLTDIVEMAAHDGGAQALKAVLEHGPTLRQRGLSLIDIVEIAGNGGGAQALKAVLKYGPVLMQAGRSNEEIVHVAARRGGAGRIRKMVAPLLERQSAD

SEQ ID NO: 422 - protein, 851 aa, artificial sequence
  Description of artificial sequence: synthetic polypeptide
MAKSGIYQIKNTLNNKVYVGSAKDFEKRWKRHFKDLEKGCHSSIKLQRSFNKHGNVFECSILEEIPYEKDLIIERENFWIKELNSKINGYNIADATFGDTCSTHPLKEEIIKKRSETVKAKMLKLGPDGRKALYSKPGIASTAFVDQDKQMANRLNLSPLERSKIEKQYGGATTLAFISNKQNELAQILSRADILKIASYDCAAHALQAVLDCGPMLGKRGFSQSDIVKIAGHDGGAQALQAVLDLESMLGKRGFSRDDIAKMAGNGGGAQTLQAVLDLESAFRERGFSQADIVKIAGNIGGAQALYSVLDVEPTLGKRGFSRADIVKIAGNGGGAQALHTVLDLEPALGKRGFSRIDIVKIAANIGGAQALHAVLDLGPTLRECGFSQATIAKIAGNIGGAQALQMVLDLGPALGKRGFSQATIAKIAGNIGGAQALQTVLDLEPALCERGFSQATIAKMAGHDGGAQALQTVLDLEPALRKRDFRQADIIKIAGHDGGAQALQAVIEHGPTLRQHGFNLADIVKMAGNGGGAQALQAVLDLKPVLDEHGFSQPDIVKMAGNIGGAQALQAVLSLGPALRERGFSQPDIVKIAGNIGGAQALQAVLDLELTLVEHGFSQADIVKIAGHDGGTQALHAVLDLERMLGERGFSRADIVNVAGHDGGAQALKAVLEHEATLNERGFSRADIVKIAGHDGGAQALKAVLEHEATLDERGFSRADIVNVAGNGGGAQALKAVLEHEATLNERGFNLTDIVEMAAHDGGAQALKAVLEHGPTLRQRGLSLIDIVEIAGNGGGAQALKAVLKYGPVLMQAGRSNEEIVHVAARRGGAGRIRKMVAPLLERQGRSSAD

SEQ ID NO: 423 - DNA, 8334 bp, artificial sequence
  Description of artificial sequence: synthetic polynucleotide
tgtgtgcggccgactgataactcgagcgatcctctagacgagctcctcgagcctgcagcagctgaagctttggacttcttcgccagaggtttggtcaagtctccaatcaaggttgtcggcttgtctaccttgccagaaatttacgaaaagatggaaaagggtcaaatcgttggtagatacgttgttgacacttctaaataagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcagatctattacattatgggtggtatgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaatgatgataataatatttatagaattgtgtagaattgcagattcccttttatggattcctaaatcctcgaggagaacttctagtatatctacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagagccgcggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatatttcaaggatataccattctaatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtgggtggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatgttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggtcaaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccacggaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatgtaaaggaatacaggtaagcaaattgatactaatggctcaacgtgataaggaaaaagaattgcactttaacattaatattgacaaggaggagggcaccacacaaaaagttaggtgtaacagaaaatcatgaaactatgattcctaatttatatattggaggattttctctaaaaaaaaaaaaatacaacaaataaaaaacactcaatgacctgaccatttgatggagtttaagtcaataccttcttgaaccatttcccataatggtgaaagttccctcaagaattttactctgtcagaaacggccttaacgacgtagtcgacctcctcttcagtactaaatctaccaataccaaatctgatggaagaatgggctaatgcatcatccttacccagcgcatgtaaaacataagaaggttctagggaagcagatgtacaggctgaacccgaggataatgcgatatcccttagtgccatcaataaagattctccttccacgtaggcgaaagaaacgttaacacaccctggataacgatgatctggagatccgttcaacgtggtatgttcagcggataatagacctttgactaatttatcggatagtcttttgatgtgagcttggtcgttgtcaaattctttcttcatcaatctcgcagcttcaccaaatcccgctaccaatgggggggccaaagtaccagatctgctgcattaatgaatcggccaacgcgcggggagaggcggtttgcgtattgggcgctcttccgcttcctcgctcactgactcgctgcgctcggtcgttcggctgcggcgagcggtatcagcatcgatgaattccacggactatagactatactagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagtgcgaagtagtgatcaggtattgctgttatctgatgagtatacgttgtcctggccacggcagaagcacgcttatcgctccaatttcccacaacattagtcaactccgttaggcccttcattgaaagaaatgaggtcatcaaatgtcttccaatgtgagattttgggccattttttatagcaaagattgaataaggcgcatttttcttcaaagctttattgtacgatctgactaagttatcttttaataattggtattcctgtttattgcttgaagaattgccggtcctatttactcgttttaggactggttcagaattcatcgatgctcactcaaaggtcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtccgatcaaaaatcatcgcttcgctgattaattaccccagaaataaggctaaaaaactaatcgcattatcatcctatggttgttaatttgattcgttcatttgaaggtttgtggggccaggttactgccaatttttcctcttcataaccataaaagctagtattgtagaatctttattgttcggagcagtgcggcgcgaggcacatctgcgtttcaggaacgcgaccggtgaagacgaggacgcacggaggagagtcttccttcggagggctgtcacccgctcggcggcttctaatccgtacttcaatatagcaatgagcagttaagcgtattactgaaagttccaaagagaaggtttttttaggctaatcgacctcgagcagatccgccaggcgtgtatatagcgtggatggccaggcaactttagtgctgacacatacaggcatatatatatgtgtgcgacgacacatgatcatatggcatgcatgtgctctgtatgtatataaaactcttgttttcttcttttctctaaatattctttccttatacattaggtcctttgtagcataaattactatacttctatagacacgcaaacacaaatacacagcggccttgccaccatggccggcgcgcccacta

SEQ ID NO: 424 - skipped

SEQ ID NO: 425 - DNA, 18 bp, artificial sequence
  Description of artificial sequence: synthetic polynucleotide
atataaacctaaccctct

SEQ ID NO: 426 - DNA, 1605 bp, artificial sequence
  Description of artificial sequence: synthetic polynucleotide
accgcgtctctctcccagagcgacatcgtcaagattgccgggaataacgggggagcacaagccctgcaagctgtcctcgacctggagagtatgctcgggaagagaggcttctcacgcgatgacatcgccaagatggccgggaacatcggcggcgcacagacccttcaggccgtgctcgatttggagtccgccttcagggagcggggattcagccaggctgacattgtcaagatcgctggacatgacggcggagcacaggctctctacagtgtgctggatgtggaacccactctgggcaagcggggcttcagccgggccgatattgtcaaaatcgcaggccacgacgggggggcccaagcccttcacactgtgttggatttggagcccgccctggggaagcgggggttttccagaatcgacattgtgaaaattgccgcccatgacggaggcgctcaggcccttcacgccgtgctggacctgggaccaacactgagggagtgtgggttttctcaggctaccatcgccaaaatcgccgggaacgggggcggagcccaggcactccagatggtgctggacttggggccagccctgggcaagagggggtttagccaggccaccatcgctaagatcgccggcaacaatggaggcgcccaagcactgcaaacagtcctggatcttgagcctgccctctgcgagagagggttttcccaggccacaattgccaaaatggccggcaacattgggggcgcacaggccctccagacagtgctggatctggaacccgccctgcggaagagggacttcaggcaggccgacatcattaaaattgctgggaatatcggcggagcccaagccttgcaggcagtcatcgaacacgggcctacactcagacagcacggcttcaatctggcagatattgtcaagatggccggaaataatgggggcgcccaagcccttcaggccgtgcttgacctcaagcccgtgttggacgagcatgggtttagtcagcccgacattgtgaaaatggctggcaacggcgggggcgctcaggcactgcaagccgtcctgtcactcggacccgccctgcgggagagagggttttctcagcctgacatcgtgaaaattgccgggaacggggggggcgcacaagctcttcaggctgtgctggacctcgaactgactctcgtggagcacgggttctcccaggccgacatcgtcaaaatcgccgggcacgatggagggacacaggccctgcacgccgtcctcgatctggagaggatgctgggcgagcggggatttagcagggccgatattgtgaacgtggccgggaacattggcggggctcaggccctgaaggcagtgttggagcacgaagccaccctgaacgagcgcggcttcaacctgacagacatcgtcgagatggctgccaatggcggaggggcccaagcattgaaggctgtcctggaacatggcccaaccctgaggcagcggggcctctccctcattgatattgtggagatcgccggccacgacggcggcgcccaggcactgaaggccgtgttgaagtatggcccagtgctgatgcaggccgggagaggagacgcc

SEQ ID NO: 427 - DNA, 16 bp, artificial sequence
  Description of artificial sequence: synthetic polynucleotide
gaagttcatctgcacc

SEQ ID NO: 428 - DNA, 5673 bp, artificial sequence
  Description of artificial sequence: synthetic polynucleotide
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaatgaattcgactcactgttgggagacccaagctggctagttaagctatcaacaagtttgtacaaaaaagcaggctggcgcgcctacacagcggccttgccaccatggccaataccaaatataacaaagagttcctgctgtacctggccggctttgtggacggtgacggtagcatcatcgctcagattaaaccaaaccagtcttataagtttaaacatcagctaagcttgacctttcaggtgactcaaaagacccagcgccgttggtttctggacaaactagtggatgaaattggcgttggttacgtacgtgatcgcggatccgtttccaactacatcttaagcgaaatcaagccgctgcacaacttcctgactcaactgcagccgtttctgaaactgaaacagaaacaggcaaacctggttctgaaaattatcgaacagctgccgtctgcaaaagaatccccggacaaattcctggaagtttgtacctgggtggatcagattgcagctctgaacgattctaagacgcgtaaaaccacttctgaaaccgttcgtgctgtgctggacagcctgagcgagaagaagaaatcctccccggcggccgactgataactcgagcgctagcacccagctttcttgtacaaagtggtgatctagagggcccgcggttcgaaggtaagcctatccctaaccctctcctcggtctcgattctacgcgtaccggttagtaatgagtttaaacgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagcagatctgcgcagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgttgacaattaatcatcggcatagtatatcggcatagtataatacgacaaggtgaggaactaaaccatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctaagcacttcgtggccgaggagcaggactgacacgtgctacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtc

SEQ ID NO: 429 - protein, 785 aa, artificial sequence
  Description of artificial sequence: synthetic polypeptide
MAKSGIYQIKNTLNNKVYVGSAKDFEKRWKRHFKDLEKGCHSSIKLQRSFNKHGNVFECSILEEIPYEKDLIIERENFWIKELNSKINGYNIADATFGDTCSTHPLKEEIIKKRSETVKAKMLKLGPDGRKALYSKPGIASTAFVDQDKQMANRLNLSPLERSKIEKQYGGATTLAFISNKQNELAQILSRADILKIASYDCAAHALQAVLDCGPMLGKRGFSQSDIVKIAGNNGGAQALQAVLDLESMLGKRGFSRDDIAKMAGNIGGAQTLQAVLDLESAFRERGFSQADIVKIAGHDGGAQALYSVLDVEPTLGKRGFSRADIVKIAGHDGGAQALHTVLDLEPALGKRGFSRIDIVKIAAHDGGAQALHAVLDLGPTLRECGFSQATIAKIAGNGGGAQALQMVLDLGPALGKRGFSQATIAKIAGNNGGAQALQTVLDLEPALCERGFSQATIAKMAGNIGGAQALQTVLDLEPALRKRDFRQADIIKIAGNIGGAQALQAVIEHGPTLRQHGFNLADIVKMAGNNGGAQALQAVLDLKPVLDEHGFSQPDIVKMAGNGGGAQALQAVLSLGPALRERGFSQPDIVKIAGNGGGAQALQAVLDLELTLVEHGFSQADIVKIAGHDGGTQALHAVLDLERMLGERGFSRADIVNVAGNIGGAQALKAVLEHEATLNERGFNLTDIVEMAANGGGAQALKAVLEHGPTLRQRGLSLIDIVEIAGHDGGAQALKAVLKYGPVLMQAGRSNEEIVHVAARRGGAGRIRKMVAPLLERQGRSSAD

SEQ ID NO: 430 - DNA, 5428 bp, artificial sequence
  Description of artificial sequence: synthetic polynucleotide
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttggtaccgagctcggatccactagtccagtgtggtggaattctgcagatatccagcacagtggcggccgctcgagtctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtc

SEQ ID NO: 431 - DNA, 6627 bp, artificial sequence
  Description of artificial sequence: synthetic polynucleotide
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaatgaattcgactcactgttgggagacccaagctggctagttaagctatcaacaagtttgtacaaaaaagcaggctggcgcgcctacacagcggccttgccaccatgggttccgaggcaccccgggccgagacctttgtcttcctggacctggaagccactgggctccccagtgtggagcccgagattgccgagctgtccctctttgctgtccaccgctcctccctggagaacccggagcacgacgagtctggtgccctagtattgccccgggtcctggacaagctcacgctgtgcatgtgcccggagcgccccttcactgccaaggccagcgagatcaccggcctgagcagtgagggcctggcgcgatgccggaaggctggctttgatggcgccgtggtgcggacgctgcaggccttcctgagccgccaggcagggcccatctgccttgtggcccacaatggctttgattatgatttccccctgctgtgtgccgagctgcggcgcctgggtgcccgcctgccccgggacactgtctgcctggacacgctgccggccctgcggggcctggaccgcgcccacagccacggcacccgggcccggggccgccagggttacagcctcggcagcctcttccaccgctacttccgggcagagccaagcgcagcccactcagccgagggcgacgtgcacaccctgctcctgatcttcctgcaccgcgccgcagagctgctcgcctgggccgatgagcaggcccgtgggtgggcccacatcgagcccatgtacttgccgcctgatgaccccagcctggaggcgactcctccacagaccggtctggatgttccttactccgaggcaccccgggccgagacctttgtcttcctggacctggaagccactgggctccccagtgtggagcccgagattgccgagctgtccctctttgctgtccaccgctcctccctggagaacccggagcacgacgagtctggtgccctagtattgccccgggtcctggacaagctcacgctgtgcatgtgcccggagcgccccttcactgccaaggccagcgagatcaccggcctgagcagtgagggcctggcgcgatgccggaaggctggctttgatggcgccgtggtgcggacgctgcaggccttcctgagccgccaggcagggcccatctgccttgtggcccacaatggctttgattatgatttccccctgctgtgtgccgagctgcggcgcctgggtgcccgcctgccccgggacactgtctgcctggacacgctgccggccctgcggggcctggaccgcgcccacagccacggcacccgggcccggggccgccagggttacagcctcggcagcctcttccaccgctacttccgggcagagccaagcgcagcccactcagccgagggcgacgtgcacaccctgctcctgatcttcctgcaccgcgccgcagagctgctcgcctgggccgatgagcaggcccgtgggtgggcccacatcgagcccatgtacttgccgcctgatgaccccagcctggaggcggccgactgataactcgagcgctagcacccagctttcttgtacaaagtggtgatctagagggcccgcggttcgaaggtaagcctatccctaaccctctcctcggtctcgattctacgcgtaccggttagtaatgagtttaaacgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagcagatctgcgcagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgttgacaattaatcatcggcatagtatatcggcatagtataatacgacaaggtgaggaactaaaccatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctaagcacttcgtggccgaggagcaggactgacacgtgctacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtc

SEQ ID NO: 432 - DNA, 3165 bp, artificial sequence
  Description of artificial sequence: synthetic polynucleotide
gcggccgcaataaaatatctttattttcattacatctgtgtgttggttttttgtgtgaatcgtaactaacatacgctctccatcaaaacaaaacgaaacaaaacaaactagcaaaataggctgtccccagtgcaagtgcaggtgccagaacatttctctatcgaaggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctacctgagatcaccggcgtgtcgacggatccagcgctctgcagccatgggctagctggccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggaattctaaaatacagcatagcaaaactttaacctccaaatcaagcctctacttgaatccttttctgagggatgaataaggcataggcatcaggggctgttgccaatgtgcattagctgtttgcagcctcaccttctttcatggagtttaagatatagtgtattttcccaaggtttgaactagctcttcatttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagcttctagcttatcctcagtcctgctcctctgccacaaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatgatggccctcctatagtgagtcgtattatactatgccgatatactatgccgatgattaattgtcaaaacagcgtggatggcgtctccagcttatctgacggttcactaaacgagctctgcttatatagacctcccaccgtacacgcctaccgcccatttgcgtcaatggggcggagttgttacgacattttggaaagtcccgttgatttactagtcaaaacaaactcccattgacgtcaatggggtggagacttggaaatccccgtgagtcaaaccgctatccacgcccattgatgtactgccaaaaccgcatcatcatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcctgcaggttaattaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatggctagttaattaacatttaaatca

SEQ ID NO: 433 - protein, 147 aa, artificial sequence
  Description of artificial sequence: synthetic polypeptide
VDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNSIVAQLSRPDP

SEQ ID NO: 434 - DNA, 3509 bp, artificial sequence
  Description of artificial sequence: synthetic polynucleotide
ggtctttcctgcgttatcccctgattctgtggataaccgtattaccgcctttgagtgagctgataccgctcgccgcagccgaacgaccgagcgcagcgagtcagtgagcgaggaagcggagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgtcaattaaccctcactaaagggaacaaaagctgttaattaagcgcgccacacgcaaacacaaatacacagcggccttgccaccatggcaaacaccggtggatcctccggagtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccggagacgcccgggggatcaggtcacgtgcgtctcggagcattgttgcccagttatctcgccctgatccgtcggccgactgataagtcgaccaccaccaccaccaccactgataagagctcctcgagcctgcagcagctgaagctttggacttctggcgcgcccaattcgccctatagtgagtcgtattacgtcgcgctcactggccgtcgttttacaacgtcgtgactgggaaaaccctggcgttacccaacttaatcgccttgcagcacatccccctttcgccagctggcgtaatagcgaagaggcccgcaccgaaacgcccttcccaacagttgcgcagcctgaatggcgaatgggagcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttggcctgtagtgggccatagccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacat

SEQ ID NO: 435 - DNA, 610 bp, artificial sequence
  Description of artificial sequence: synthetic polynucleotide
ggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggag

SEQ ID NO: 436 - DNA, 16 bp, artificial sequence
  Description of artificial sequence: synthetic polynucleotide
gaccctgaagttcatc

SEQ ID NO: 437 - DNA, 6134 bp, artificial sequence
  Description of artificial sequence: synthetic polynucleotide
atgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaatgaattcgactcactgttgggagacccaagctggctagttaagctatcacaagtttgtacaaaaaagcaggctggcgcgccacacgcaaacacaaatacacagcggccttgccaccatggccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaactggggcctgatggcagaaaggcactctactctaagccaggttccggagtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccggagacgcccgggggatcaggtcacgtgcgtctcggagcattgttgcccagttatctcgccctgatccgtcggccgactgataagtcgaccaccaccaccaccaccactgataagagctcctcgagcgctagcacccagctttcttgtacaaagtggtgatctagagggcccgcggttcgaaggtaagcctatccctaaccctctcctcggtctcgattctacgcgtaccggttagtaatgagtttaaacgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagcagatctgcgcagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgttgacaattaatcatcggcatagtatatcggcatagtataatacgacaaggtgaggaactaaaccatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctaagcacttcgtggccgaggagcaggactgacacgtgctacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaac

SEQ ID NO: 438 - protein, 820 aa, artificial sequence
  artificial sequence	Description of artificial sequence: synthetic polypeptide
MAKSGIYQIKNTLNNKVYVGSAKDFEKRWKRHFKDLEKGCHSSIKLQRSFNKHGNVFECSILEEIPYEKDLIIERENFWIKELNSKINGYNIADATFGDTCSTHPLKEEIIKKRSETVKAKMLKLGPDGRKALYSKPGSGVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNGGGRPALESIVAQLSRPDPSAD

SEQ ID NO: 439 - DNA, 1086 bp, artificial sequence; identical to SEQ ID NO: 124
  Description of artificial sequence: synthetic polynucleotide

SEQ ID NO: 440 - DNA, 1491 bp, artificial sequence
  Description of artificial sequence: synthetic polynucleotide
atgggcgatcctaaaaagaaacgtaaggtcatcgattacccatacgatgttccagattacgctatcgatatcgcctcaaccgccttcgtggaccaggataagcaaatggccaaccgcttgaacctgagtcccctggagaggtctaagattgagaagcagtacggcggggccacaactctggcctttatctccaacaagcagaacgagctggcccagatccttagccgggcagacatcttgaagattgcctcctatgattgtgctgcacacgccctccaggctgtcctcgattgcgggccaatgctggggaagagaggattctccggagacgcccgggggatcaggtcacgtgcgtctcggagacccgatccagccttggcagctctgagcaacgaggaaatcgtgcacgtcgccgccaggcgcgggggagccggcagaattaggaagatggtggcccctctccttgagcggcagggcagatctggctcggatcctaagaagaagcggaaggtggaggccagcggctctggaagggccgacgccttggacgatttcgatcttgatatgctcggcagcgatgcccttgatgactttgacctcgatatgctgggctccgacgctctcgatgatttcgacctggatatgttggggtccgacgccctggacgacttcgacttggacatgctgattaactctagaggcagtggagagggcagaggaagtctgctaacatgcggtgacgtcgaggagaatcctggcccagtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaaggcggccgactgataa

SEQ ID NO: 441 - DNA, 3426 bp, artificial sequence
  Description of artificial sequence: synthetic polynucleotide
atgggcgatcctaaaaagaaacgtaaggtcatcgattacccatacgatgttccagattacgctatcgatatcgcctcaaccgccttcgtggaccaggataagcaaatggccaaccgcttgaacctgagtcccctggagaggtctaagattgagaagcagtacggcggggccacaactctggcctttatctccaacaagcagaacgagctggcccagatccttagccgggcagacatcttgaagattgcctcctatgattgtgctgcacacgccctccaggctgtcctcgattgcgggccaatgctggggaagagaggattctcccagagtgatattgtaaaaatcgctggcaacattggaggagcccaggctcttcaggctgtgctggacctggaatccatgcttggcaagcggggcttcagccgcgacgacatcgccaaaatggccggcaacattggcggagcccagactcttcaggccgtgctggacttggagtccgccttcagggagcgggggttctcccaggctgatattgtcaagatcgccggaaacaatggcggggcccaggccctgtattccgtgctggacgtggaaccaacactggggaaacgggggttctctcgggccgacattgtgaagatcgctgggaacacagggggcgcccaagccctccacactgtgttggatctggagccagccctcgggaagagaggcttcagccggattgacattgtgaaaattgccgccaacaacgggggagcccaggcccttcatgctgtgctcgatctgggacccacactgagggagtgcggcttcagccaggccacaatcgccaagatcgcaggcaacatcggaggcgctcaagccctccagatggtcctcgacctgggacctgccttgggcaagagggggttcagccaggctacaatcgctaagatcgcaggaaacatcgggggcgctcaggcactccagacagtgctggatttggagcctgccctgtgtgagagggggttttcccaggccaccatcgccaagatggccgggaataacggcggcgcccaagcattgcagaccgtgctcgacctggagcccgccctgaggaagagggattttcgccaggccgatattatcaagatcgctggaaatgatggcggcgctcaggccctccaggctgtgatcgagcacgggccaaccctgaggcagcacgggttcaacctggctgacattgtcaagatggctgggaacatcggcggggctcaggccctgcaagccgtgctggatctgaagcccgtcttggacgaacatgggtttagccagcctgatattgtgaagatggccggaaacatcggcggagcacaggcccttcaagccgtgctcagcttggggcccgcactgagggagagagggttctcacagcccgacatcgtgaagattgccggaaacactgggggggcccaagccttgcaggcagtcctggacctggagctgactctggtggagcacggcttctcccagccagacattgtgcggatcacaggcaaccgggggggagcacaggctctccaggccgtcctggcccttgagctgaccctgagagagcgggggtttagccaacccgatattgtaaagattgccggcaactccgggggcgcacaggccctccaagccgtcctggatctggagttgacctttagggagcggggatttagccaggccgacatcgtcaaaattgccgggaacgatgggggcacccaggccctgcacgccgtcctcgatctggagagaatgctgggcgagagagggttttcacgggctgacatcgtgaacgtggccgggaacaacggcggggcccaagcactcaaggccgtgctcgaacacgaagccactctgaacgagaggggcttttctagggccgatattgtgaaaatcgccggcaacggcggaggcgcccaggccctcaaagccgtccttgaacacgaggccacactcgatgagcggggctttagccgggcagacatcgtgaggatcgccgggaacgggggaggggcccaggctctgaaggctgtcctggagcacgggcctaccctgaacgagcgcggcttcaacctcacagatattgtggagatggccgccaacagcggaggggcccaagctctcaaggccgtcttggagcatggccccaccctgagacagagagggctcagtttgattgatattgtcgaaatcgcctccaacggaggggcacaagcccttaaggccgtgttgaagtacggccccgtcctgatgcaggccgggagacccgatccagccttggcagctctgagcaacgaggaaatcgtgcacgtcgccgccaggcgcgggggagccggcagaattaggaagatggtggcccctctccttgagcggcagggcagatctggctcggatcctaagaagaagcggaaggtggaggccagcggctctggaagggccgacgccttggacgatttcgatcttgatatgctcggcagcgatgcccttgatgactttgacctcgatatgctgggctccgacgctctcgatgatttcgacctggatatgttggggtccgacgccctggacgacttcgacttggacatgctgattaactctagaggcagtggagagggcagaggaagtctgctaacatgcggtgacgtcgaggagaatcctggcccagtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaaggcggccgactgataa

SEQ ID NO: 442 - DNA, 3033 bp, artificial sequence
  Description of artificial sequence: synthetic polynucleotide
atgggcgatcctaaaaagaaacgtaaggtcatcgattacccatacgatgttccagattacgctatcgatatcgcctcaaccgccttcgtggaccaggataagcaaatggccaaccgcttgaacctgagtcccctggagaggtctaagattgagaagcagtacggcggggccacaactctggcctttatctccaacaagcagaacgagctggcccagatccttagccgggcagacatcttgaagattgcctcctatgattgtgctgcacacgccctccaggctgtcctcgattgcgggccaatgctggggaagagaggattctcccagagtgatattgtcaaaattgcaggaaataacggaggagcccaagctctgcaagccgtgcttgacctggagagcatgttgggcaaaagaggcttttccagggacgatattgccaaaatggccgggcacgacggaggcgctcagacattgcaggctgtcctcgacttggagagcgcttttagggagcggggcttctcccaggccgacattgtgaaaattgccgggaacattgggggagcccaggcactgtactccgtcctcgacgtggaacctacccttggaaagaggggctttagccgggctgatattgtgaagatcgcaggacatgacggcggcgctcaagcactgcataccgtgctcgatctggagcccgccctcggaaaaagagggttctctagaatcgacatcgtgaaaatcgccgcccacgatggaggcgcccaggccctgcacgccgtgctggatttggggccaacccttcgcgaatgcggcttttcacaggctaccatcgcaaagatcgctgggaatatcggcggggcccaggctttgcagatggtcctggacttgggcccagccctgggaaagagaggcttcagccaggccactattgccaagatcgccggcaacggaggcggcgcacaggctctccagacagtgttggacctcgaacccgcactttgcgagagggggttttcccaggccaccatcgccaagatggctggcaacaacggcggagcacaagccctgcaaactgtgctcgatttggagccagccctgcggaagagagacttccggcaggctgacattattaagattgcaggcaataacgggggagcccaagcacttcaggcagtcattgaacatggacctacattgcgccagcatggattcaacctcgccgacattgtcaagatggctggcaatggagggggcgcccaggccctgcaagccgtcctggatctgaagcctgtgttggacgagcacggcttcagccagccagacattgtgaagatggccggaaataacggcggggcacaggctcttcaggccgtgctttccttggggcccgctctccgggagcggggctttagccagcctgatattgtgaaaatcgcaggcaacgggggcggagcacaggccctccaggcagtgctggatctcgaactcaccttggtggagcatgggttcagtcaggccgatattgtcaaaattgctggacacgacggcggaacccaagctctccacgctgtgctcgacctggaaaggatgctcggggagagagggtttagcagggctgacatcgtgaacgtggccggcaacggaggaggggcccaagccctgaaggctgtgctggagcacgaagccactctgaacgagcgcgggttcaacctgaccgacatcgtggagatggccgccaacaacggaggcgctcaggcactgaaggccgtcttggagcacgggcctacactcagacagcggggcctgtccttgattgacattgtcgagattgcaggcaatgggggaggagcccaggctctcaaggctgtgttgaagtacggccccgtcctcatgcaggccgggagacccgatccagccttggcagctctgagcaacgaggaaatcgtgcacgtcgccgccaggcgcgggggagccggcagaattaggaagatggtggcccctctccttgagcggcagggcagatctggctcggatcctaagaagaagcggaaggtggaggccagcggctctggaagggccgacgccttggacgatttcgatcttgatatgctcggcagcgatgcccttgatgactttgacctcgatatgctgggctccgacgctctcgatgatttcgacctggatatgttggggtccgacgccctggacgacttcgacttggacatgctgattaactctagaggcagtggagagggcagaggaagtctgctaacatgcggtgacgtcgaggagaatcctggcccagtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaaggcggccgactgataa

SEQ ID NO: 443 - DNA, 21 bp, artificial sequence
  Description of artificial sequence: synthetic polynucleotide
taagagaagcaaagacgttac

SEQ ID NO: 444 - DNA, 17 bp, artificial sequence
  Description of artificial sequence: synthetic polynucleotide
tgcaccatggtgtctgt

SEQ ID NO: 445 - DNA, 15 bp, artificial sequence
  Description of artificial sequence: synthetic polynucleotide
tcccgagtccccaat

SEQ ID NO: 446 - DNA, 831 bp, artificial sequence
  Description of artificial sequence: synthetic polynucleotide
caattgtctagataagagaagcaaagacgttacggatccacgtatgtcgaggtaggcgtgtacggtgggaggcctatataagcagagctcgtttagtgaaccgtcagatcgcctggaggtaccgccaccatgagcgagctgattaaggagaacatgcacatgaagctgtacatggagggcaccgtggacaaccatcacttcaagtgcacatccgagggcgaaggcaagccctacgagggcacccagaccatgagaatcaaggtggtcgagggcggccctctccccttcgccttcgacatcctggctactagcttcctctacggcagcaagaccttcatcaaccacacccagggcatccccgacttcttcaagcagtccttccctgagggcttcacatgggagagagtcaccacatacgaagacgggggcgtgctgaccgctacccaggacaccagcctccaggacggctgcctcatctacaacgtcaagatcagaggggtgaacttcacatccaacggccctgtgatgcagaagaaaacactcggctgggaggccttcaccgagacgctgtaccccgctgacggcggcctggaaggcagaaacgacatggccctgaagctcgtgggcgggagccatctgatcgcaaacatcaagaccacatatagatccaagaaacccgctaagaacctcaagatgcctggcgtctactatgtggactacagactggaaagaatcaaggaggccaacaacgagacctacgtcgagcagcacgaggtggcagtggccagatactgcgacctccctagcaaactggggcacaagcttaattaa

SEQ ID NO: 447 - DNA, 824 bp, artificial sequence
  Description of artificial sequence: synthetic polynucleotide
caattgtctagatcccgagtccccaaggatccacgtatgtcgaggtaggcgtgtacggtgggaggcctatataagcagagctcgtttagtgaaccgtcagatcgcctggaggtaccgccaccatgagcgagctgattaaggagaacatgcacatgaagctgtacatggagggcaccgtggacaaccatcacttcaagtgcacatccgagggcgaaggcaagccctacgagggcacccagaccatgagaatcaaggtggtcgagggcggccctctccccttcgccttcgacatcctggctactagcttcctctacggcagcaagaccttcatcaaccacacccagggcatccccgacttcttcaagcagtccttccctgagggcttcacatgggagagagtcaccacatacgaagacgggggcgtgctgaccgctacccaggacaccagcctccaggacggctgcctcatctacaacgtcaagatcagaggggtgaacttcacatccaacggccctgtgatgcagaagaaaacactcggctgggaggccttcaccgagacgctgtaccccgctgacggcggcctggaaggcagaaacgacatggccctgaagctcgtgggcgggagccatctgatcgcaaacatcaagaccacatatagatccaagaaacccgctaagaacctcaagatgcctggcgtctactatgtggactacagactggaaagaatcaaggaggccaacaacgagacctacgtcgagcagcacgaggtggcagtggccagatactgcgacctccctagcaaactggggcacaagcttaattaa

SEQ ID NO: 448 - DNA, 827 bp, artificial sequence
  Description of artificial sequence: synthetic polynucleotide
caattgtctagatgcaccatggtgtctgtggatccacgtatgtcgaggtaggcgtgtacggtgggaggcctatataagcagagctcgtttagtgaaccgtcagatcgcctggaggtaccgccaccatgagcgagctgattaaggagaacatgcacatgaagctgtacatggagggcaccgtggacaaccatcacttcaagtgcacatccgagggcgaaggcaagccctacgagggcacccagaccatgagaatcaaggtggtcgagggcggccctctccccttcgccttcgacatcctggctactagcttcctctacggcagcaagaccttcatcaaccacacccagggcatccccgacttcttcaagcagtccttccctgagggcttcacatgggagagagtcaccacatacgaagacgggggcgtgctgaccgctacccaggacaccagcctccaggacggctgcctcatctacaacgtcaagatcagaggggtgaacttcacatccaacggccctgtgatgcagaagaaaacactcggctgggaggccttcaccgagacgctgtaccccgctgacggcggcctggaaggcagaaacgacatggccctgaagctcgtgggcgggagccatctgatcgcaaacatcaagaccacatatagatccaagaaacccgctaagaacctcaagatgcctggcgtctactatgtggactacagactggaaagaatcaaggaggccaacaacgagacctacgtcgagcagcacgaggtggcagtggccagatactgcgacctccctagcaaactggggcacaagcttaattaa

SEQ ID NO: 449 - DNA, 702 bp, artificial sequence
  Description of artificial sequence: synthetic polynucleotide
atgagcgagctgattaaggagaacatgcacatgaagctgtacatggagggcaccgtggacaaccatcacttcaagtgcacatccgagggcgaaggcaagccctacgagggcacccagaccatgagaatcaaggtggtcgagggcggccctctccccttcgccttcgacatcctggctactagcttcctctacggcagcaagaccttcatcaaccacacccagggcatccccgacttcttcaagcagtccttccctgagggcttcacatgggagagagtcaccacatacgaagacgggggcgtgctgaccgctacccaggacaccagcctccaggacggctgcctcatctacaacgtcaagatcagaggggtgaacttcacatccaacggccctgtgatgcagaagaaaacactcggctgggaggccttcaccgagacgctgtaccccgctgacggcggcctggaaggcagaaacgacatggccctgaagctcgtgggcgggagccatctgatcgcaaacatcaagaccacatatagatccaagaaacccgctaagaacctcaagatgcctggcgtctactatgtggactacagactggaaagaatcaaggaggccaacaacgagacctacgtcgagcagcacgaggtggcagtggccagatactgcgacctccctagcaaactggggcacaagcttaattaa

SEQ ID NO: 450 - DNA, 681 bp, artificial sequence
  Description of artificial sequence: synthetic polynucleotide
atggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgggctaa

SEQ ID NO: 451 - skipped

SEQ ID NO: 452 - protein, 4 aa, artificial sequence
  Description of artificial sequence: synthetic polypeptide
DSVI

SEQ ID NO: 453 - protein, 4 aa, artificial sequence
  Description of artificial sequence: synthetic polypeptide
IVEA

SEQ ID NO: 454 - protein, 4 aa, artificial sequence
  Description of artificial sequence: synthetic polypeptide
LEGS

SEQ ID NO: 455 - protein, 4 aa, artificial sequence
  Description of artificial sequence: synthetic polypeptide
YTST

SEQ ID NO: 456 - protein, 5 aa, artificial sequence
  Description of artificial sequence: synthetic polypeptide
LQENL

SEQ ID NO: 457 - protein, 5 aa, artificial sequence
  Description of artificial sequence: synthetic polypeptide
VGRQP

SEQ ID NO: 458 - protein, 5 aa, artificial sequence
  Description of artificial sequence: synthetic polypeptide
LGNSL

SEQ ID NO: 459 - protein, 6 aa, artificial sequence
  Description of artificial sequence: synthetic polypeptide
LPEEKG

SEQ ID NO: 460 - protein, 6 aa, artificial sequence
  Description of artificial sequence: synthetic polypeptide
QTYQPA

SEQ ID NO: 461 - protein, 6 aa, artificial sequence
  Description of artificial sequence: synthetic polypeptide
FSHSTT

SEQ ID NO: 462 - protein, 7 aa, artificial sequence
  Description of artificial sequence: synthetic polypeptide
GYTYINP

SEQ ID NO: 463 - protein, 7 aa, artificial sequence
  Description of artificial sequence: synthetic polypeptide
LTKYKSS

SEQ ID NO: 464 - protein, 8 aa, artificial sequence
  Description of artificial sequence: synthetic polypeptide
SRPSESEG

SEQ ID NO: 465 - protein, 8 aa, artificial sequence
  Description of artificial sequence: synthetic polypeptide
PELKQKSS

SEQ ID NO: 466 - protein, 8 aa, artificial sequence
  Description of artificial sequence: synthetic polypeptide
LTTNLTAF

SEQ ID NO: 467 - protein, 9 aa, artificial sequence
  Description of artificial sequence: synthetic polypeptide
TATPPGSVT

SEQ ID NO: 468 - protein, 9 aa, artificial sequence
  Description of artificial sequence: synthetic polypeptide
LDNFINRPV

SEQ ID NO: 469 - protein, 9 aa, artificial sequence
  Description of artificial sequence: synthetic polypeptide
VSSAKTTAP

SEQ ID NO: 470 - protein, 10 aa, artificial sequence
  Description of artificial sequence: synthetic polypeptide
DSKAPNASNL

SEQ ID NO: 471 - protein, 10 aa, artificial sequence
  Description of artificial sequence: synthetic polypeptide
KRRTTISIAA

SEQ ID NO: 472 - protein, 11 aa, artificial sequence
  Description of artificial sequence: synthetic polypeptide
PVKMFDRHSSL

SEQ ID NO: 473 - protein, 11 aa, artificial sequence
  Description of artificial sequence: synthetic polypeptide
APAETKAEPMT

SEQ ID NO: 474 - protein, 14 aa, artificial sequence
  Description of artificial sequence: synthetic polypeptide
YTRLPERSELPAEI

SEQ ID NO: 475 - protein, 14 aa, artificial sequence
  Description of artificial sequence: synthetic polypeptide
VSTDSTPVTNQKSS

SEQ ID NO: 476 - protein, 14 aa, artificial sequence
  Description of artificial sequence: synthetic polypeptide
YKLPAVTTMKVRPA

SEQ ID NO: 477 - protein, 15 aa, artificial sequence
  Description of artificial sequence: synthetic polypeptide
IARTDLKKNRDYPLA

SEQ ID NO: 478 - protein, 21 aa, artificial sequence
  Description of artificial sequence: synthetic polypeptide
TEEPGAPLTTPPTLHGNQARA

SEQ ID NO: 479 - protein, 21 aa, artificial sequence
  Description of artificial sequence: synthetic polypeptide
ARFTLAVGDNRVLDMASTYFD

SEQ ID NO: 480 - protein, 26 aa, artificial sequence
  Description of artificial sequence: synthetic polypeptide
IVVLNRAETPLPLDPTGKVKAELDTR

SEQ ID NO: 481 - protein, 28 aa, artificial sequence
  Description of artificial sequence: synthetic polypeptide
ILNKEKKAVSPLLLTTTNSSEGLSMGNY

SEQ ID NO: 482 - protein, 20 aa, artificial sequence
  Description of artificial sequence: synthetic polypeptide
GSDITKSKISEKMKGQGPSG

SEQ ID NO: 483 - protein, 23 aa, artificial sequence
  Description of artificial sequence: synthetic polypeptide
GSDITKSKISEKMKGLGPDGRKA

SEQ ID NO: 484 - protein, 10 aa, artificial sequence
  Description of artificial sequence: synthetic polypeptide
SLTKSKISGS

SEQ ID NO: 485 - protein, 32 aa, artificial sequence
  Description of artificial sequence: synthetic polypeptide
AAGGSALTAGALSLTAGALSLTAGALSGGGGS

SEQ ID NO: 486 - protein, 27 aa, artificial sequence
  Description of artificial sequence: synthetic polypeptide
AAGASSVSASGHIAPLSLPSSPPSVGS

SEQ ID NO: 487 - protein, 5 aa, artificial sequence
  Description of artificial sequence: synthetic polypeptide
QGPSG

SEQ ID NO: 488 - protein, 8 aa, artificial sequence
  Description of artificial sequence: synthetic polypeptide
LGPDGRKA

SEQ ID NO: 489 - protein, 7 aa, artificial sequence
  Description of artificial sequence: synthetic polypeptide
GRSGSDP

SEQ ID NO: 490-491 - skipped (2 entries)

SEQ ID NO: 492 - protein, 15 aa, artificial sequence
  Description of artificial sequence: synthetic polypeptide
SGGSGSNVGSGSGSG

SEQ ID NO: 493 - protein, 20 aa, artificial sequence
  Description of artificial sequence: synthetic polypeptide
SGGSGSLTTNLTAFSGSGSG

SEQ ID NO: 494 - protein, 22 aa, artificial sequence
  Description of artificial sequence: synthetic polypeptide
SGGSGSKRRTTISIAASGSGSG

SEQ ID NO: 495 - protein, 17 aa, artificial sequence
  Description of artificial sequence: synthetic polypeptide
SGGSGSVGRQPSGSGSG

SEQ ID NO: 496 - protein, 26 aa, artificial sequence	Description of artificial sequence: synthetic polypeptide	TAL5	SGGSGSYTRLPERSELPAEISGSGSG
  Description of artificial sequence: synthetic polypeptide
SGGSGSYTRLPERSELPAEISGSGSG

SEQ ID NO: 497 - protein, 38 aa, artificial sequence
  Description of artificial sequence: synthetic polypeptide
SGGSGSIVVLNRAETPLPLDPTGKVKAELDTRSGSGSG

SEQ ID NO: 498 - protein, 21 aa, artificial sequence
  Description of artificial sequence: synthetic polypeptide
SGGSGSTATPPGSVTSGSGSG

SEQ ID NO: 499 - protein, 21 aa, artificial sequence
  Description of artificial sequence: synthetic polypeptide
SGGSGSLDNFINRPVSGSGSG

SEQ ID NO: 500 - protein, 21 aa, artificial sequence
  Description of artificial sequence: synthetic polypeptide
SGGSGSVSSAKTTAPSGSGSG

SEQ ID NO: 501 - protein, 22 aa, artificial sequence
  Description of artificial sequence: synthetic polypeptide
SGGSGSDSKAPNASNLSGSGSG

SEQ ID NO: 502 - protein, 23 aa, artificial sequence
  Description of artificial sequence: synthetic polypeptide
SGGSGSPVKMFDRHSSLSGSGSG

SEQ ID NO: 503 - protein, 23 aa, artificial sequence
  Description of artificial sequence: synthetic polypeptide
SGGSGSAPAETKAEPMTSGSGSG

SEQ ID NO: 504 - protein, 26 aa, artificial sequence
  Description of artificial sequence: synthetic polypeptide
SGGSGSVSTDSTPVTNQKSSSGSGSG

SEQ ID NO: 505 - protein, 16 aa, artificial sequence
  Description of artificial sequence: synthetic polypeptide
SGGSGSDSVISGSGSG

SEQ ID NO: 506 - protein, 33 aa, artificial sequence
  Description of artificial sequence: synthetic polypeptide
SGGSGSARFTLAVGDNRVLDMASTYFDSGSGSG

SEQ ID NO: 507 - protein, 17 aa, artificial sequence
  Description of artificial sequence: synthetic polypeptide
SGGSGSLQENLSGSGSG

SEQ ID NO: 508 - protein, 19 aa, artificial sequence
  Description of artificial sequence: synthetic polypeptide
SGGSGSGYTYINPSGSGSG

SEQ ID NO: 509 - protein, 26 aa, artificial sequence
  Description of artificial sequence: synthetic polypeptide
SGGSGSYKLPAVTTMKVRPASGSGSG

SEQ ID NO: 510 - protein, 16 aa, artificial sequence
  Description of artificial sequence: synthetic polypeptide
SGGSGSLEGSSGSGSG

SEQ ID NO: 511 - protein, 16 aa, artificial sequence
  Description of artificial sequence: synthetic polypeptide
SGGSGSIVEASGSGSG

SEQ ID NO: 512 - protein, 18 aa, artificial sequence
  Description of artificial sequence: synthetic polypeptide
SGGSGSQTYQPASGSGSG

SEQ ID NO: 513 - protein, 27 aa, artificial sequence
  Description of artificial sequence: synthetic polypeptide
SGGSGSIARTDLKKNRDYPLASGSGSG

SEQ ID NO: 514 - protein, 18 aa, artificial sequence
  Description of artificial sequence: synthetic polypeptide
SGGSGSLPEEKGSGSGSG

SEQ ID NO: 515 - protein, 16 aa, artificial sequence
  Description of artificial sequence: synthetic polypeptide
SGGSGSYTSTSGSGSG

SEQ ID NO: 516 - protein, 20 aa, artificial sequence
  Description of artificial sequence: synthetic polypeptide
SGGSGSSRPSESEGSGSGSG

SEQ ID NO: 517 - protein, 17 aa, artificial sequence
  Description of artificial sequence: synthetic polypeptide
SGGSGSLGNSLSGSGSG

SEQ ID NO: 518 - protein, 19 aa, artificial sequence
  Description of artificial sequence: synthetic polypeptide
SGGSGSLTKYKSSSGSGSG

SEQ ID NO: 519 - protein, 33 aa, artificial sequence
  Description of artificial sequence: synthetic polypeptide
SGGSGSTEEPGAPLTTPPTLHGNQARASGSGSG

SEQ ID NO: 520 - protein, 18 aa, artificial sequence
  Description of artificial sequence: synthetic polypeptide
SGGSGSFSHSTTSGSGSG

SEQ ID NO: 521 - protein, 20 aa, artificial sequence
  Description of artificial sequence: synthetic polypeptide
SGGSGSPELKQKSSSGSGSG

SEQ ID NO: 522 - protein, 40 aa, artificial sequence
  Description of artificial sequence: synthetic polypeptide
SGGSGSILNKEKKAVSPLLLTTTNSSEGLSMGNYSGSGSG

SEQ ID NO: 523 - protein, 31 aa, artificial sequence
  Description of artificial sequence: synthetic polypeptide
ELAEFHARYADLLLRDLRERPVSLVRGPDSG

SEQ ID NO: 524 - protein, 31 aa, artificial sequence
  Description of artificial sequence: synthetic polypeptide
ELAEFHARPDPLLLRDLRERPVSLVRGLGSG

SEQ ID NO: 525 - protein, 26 aa, artificial sequence
  Description of artificial sequence: synthetic polypeptide
ELAEFHARYADLLLRDLRERSGSGSG

SEQ ID NO: 526 - protein, 31 aa, artificial sequence
  Description of artificial sequence: synthetic polypeptide
DIFDYYAGVAEVMLGHIAGRPATRKRWPNSG

SEQ ID NO: 527 - protein, 31 aa, artificial sequence
  Description of artificial sequence: synthetic polypeptide
DIFDYYAGPDPVMLGHIAGRPATRKRWLGSG

SEQ ID NO: 528 - protein, 26 aa, artificial sequence
  Description of artificial sequence: synthetic polypeptide
DIFDYYAGVAEVMLGHIAGRSGSGSG

SEQ ID NO: 529 - protein, 37 aa, artificial sequence
  Description of artificial sequence: synthetic polypeptide
SIVAQLSRPDPALVSFQKLKLACLGGRPALDAVKKGL

SEQ ID NO: 530 - protein, 37 aa, artificial sequence
  Description of artificial sequence: synthetic polypeptide
SIVAQLSRPDPAAVSAQKAKAACLGGRPALDAVKKGL

SEQ ID NO: 531 - protein, 37 aa, artificial sequence
  Description of artificial sequence: synthetic polypeptide
SIVAQLSRPDPAVVTFHKLKLACLGGRPALDAVKKGL

SEQ ID NO: 532 - protein, 44 aa, artificial sequence
  Description of artificial sequence: synthetic polypeptide
SIVAQLSRPDPAQSLAQELSLNESQIKIACLGGRPALDAVKKGL

SEQ ID NO: 533 - protein, 40 aa, artificial sequence
  Description of artificial sequence: synthetic polypeptide
SIVAQLSRPDPALQLPPLERLTLDACLGGRPALDAVKKGL

SEQ ID NO: 534 - protein, 38 aa, artificial sequence
  Description of artificial sequence: synthetic polypeptide
SIVAQLSRPDPAIHKKFSSIQMACLGGRPALDAVKKGL

SEQ ID NO: 535 - protein, 40 aa, artificial sequence
  Description of artificial sequence: synthetic polypeptide
SIVAQLSRPDPAAAAATNDHAVAAACLGGRPALDAVKKGL

SEQ ID NO: 536 - DNA, 69 bp, Burkholderia rhizoxinica
  misc_feature (1)..(69): Figure 11; WT
aaccccattgtccgggaacccagagctcacagccacgatcttagacccgagcccacagagccagaggtg

SEQ ID NO: 537 - DNA, 64 bp, Burkholderia rhizoxinica
aaccccattgtccgggaacccagagctcacagatcttagacccgagcccacagagccagaggtg

SEQ ID NO: 538 - DNA, 65 bp, Burkholderia rhizoxinica
aaccccattgtccgggaacccagagctcacagcatcttagacccgagcccacagagccagaggtg

SEQ ID NO: 539 - DNA, 65 bp, Burkholderia rhizoxinica
aaccccattgtccgggaacccagagctcacagcctcttagacccgagcccacagagccagaggtg

SEQ ID NO: 540 - DNA, 43 bp, Burkholderia rhizoxinica
aaccccattgtccgggaacccagagctcacagagccagaggtg

SEQ ID NO: 541 - DNA, 66 bp, Burkholderia rhizoxinica
aaccccattgtccgggaacccagagctcacagcgatcttagacccgagcccacagagccagaggtg

SEQ ID NO: 542 - DNA, 69 bp, Burkholderia rhizoxinica; identical to SEQ ID NO: 536
  misc_feature (1)..(69): Figure 12: WT

SEQ ID NO: 543 - DNA, 65 bp, Burkholderia rhizoxinica; identical to SEQ ID NO: 538

SEQ ID NO: 544 - DNA, 64 bp, Burkholderia rhizoxinica; identical to SEQ ID NO: 537

SEQ ID NO: 545 - DNA, 66 bp, Burkholderia rhizoxinica; identical to SEQ ID NO: 541

SEQ ID NO: 546 - DNA, 43 bp, Burkholderia rhizoxinica; identical to SEQ ID NO: 540

SEQ ID NO: 547 - DNA, 66 bp, Burkholderia rhizoxinica
aaccccattgtccgggaacccagagctcacagccatcttagacccgagcccacagagccagaggtg

SEQ ID NO: 548 - protein, 81 aa, Artificial Sequence
  Nter BurrH 36
STAFVDQDKQMANRLNLSPLERSKIEKQYGGATTLAFISNKQNELAQILSRADILKIASYDCAAHALQAVLDCGPMLGKRG

SEQ ID NO: 549 - protein, 81 aa, Artificial Sequence
  pCLS21512
STAFVDQDKQMANRLNLSPLERSKIEKQNGGATTLAFISNKQNELAQILSRADILKIASQGCAAHALQAVLDCGPMLGKRG

SEQ ID NO: 550 - protein, 82 aa, Artificial Sequence
  pCLS21513
STAFVDQDKQMANRLNLSPLERSKIEKQWSGARTLAFISNKQNELAQIGLSRADILKIASKRGGAHALQAVLDCGPMLGKRG

SEQ ID NO: 551 - protein, 114 aa, Artificial Sequence
  pCLS21514
STAFVDQDKQMANRLNLSPLERSKIEKQYGGATTLAFISNKQNELAQILSRADILKIASYDCAAHALQAVLDCGPMLGKRGLSQADIVKIASNGGGAQALKAVLDCGPMLGERG

SEQ ID NO: 552 - protein, 81 aa, Artificial Sequence
  pCLS21515
STAFVDQDKQMANRLNLSPLERSKIEKQYGGATTLAFISNKQNELAQILSRADILKIAGNGGGAHALQAVLDCGPMLGKRG

SEQ ID NO: 553 - protein, 81 aa, Artificial Sequence
  pCLS21516
STAFVDQDKQMANRLNLSPLERSKIEKQWGGATTLAFISNKQNELAQILSRADILKIAGNGGGAHALQAVLDCGPMLGKRG

SEQ ID NO: 554 - protein, 81 aa, Artificial Sequence
  pCLS21517
STAFVDQDKQMANRLNLSPLERSKIEKQWSGATTLAFISNKQNELAQILSRADILKIASKRCAAHALQAVLDCGPMLGKRG

SEQ ID NO: 555 - protein, 82 aa, Artificial Sequence
  pCLS21518
STAFVDQDKQMANRLNLSPLERSKIEKQTGGATTLAFISNKQNELAQIGLSRADILKIASYGCAAHALQAVLDCGPMLGKRG

SEQ ID NO: 556 - protein, 81 aa, Artificial Sequence
  pCLS21519
STAFVDQDKQMANRLNLSPLERSKIEKQRGGATTLAFISNKQNELAQILSRADILKIAKRGGAAHALQAVLDCGPMLGKRG

SEQ ID NO: 557 - protein, 82 aa, Artificial Sequence
  pCLS21520
STAFVDQDKQMANRLNLSPLERSKIEKQYGGATTLAFISNKQNELAQIGFSQADILKIAGNGGGAHALQAVLDCGPTLGKRG

SEQ ID NO: 558 - protein, 132 aa, Artificial Sequence
  pCLS21521
ADLRTLGYSQQQQEKIKPKVRSTVAQHHEALVGHGFTHAHIVALSQHPAALGTVAVKYQDMIAALPEATHEAIVGVGKQWSGARTLAFISNKQNELAQILSRADILKIASKRGGAHALQAVLDCGPMLGKRG

SEQ ID NO: 559 - protein, 55 aa, Artificial Sequence; identical to SEQ ID NO: 412
  Nter BurrH_36( 26)

The invention claimed is:

1. A nucleic acid binding polypeptide that comprises a succession of at least 12 modules, wherein each module consists of 30 to 35 contiguous amino acid residues, wherein said succession of modules displays a base per base specificity towards a nucleic acid target sequence,
wherein at least one of said modules has at least 70% sequence identity with one of the module polypeptide sequences from proteins E5AV36, E5AW43 and E5AW45 of *Burkholderia rhizoxinica;*
wherein said nucleic acid binding polypeptide is fused to a catalytic domain from I-TevI, and
wherein said polypeptide binds to and cleaves the nucleic acid target sequence on a chromosome in a mammalian cell.

2. The nucleic acid binding polypeptide according to claim 1, wherein said module polypeptide sequence has at least 90% sequence identity with a polypeptide sequence selected from the group consisting of: SEQ ID NO: 162 to 181, SEQ ID NO: 31 to SEQ ID NO: 36 and SEQ ID NO: 37 to SEQ ID NO: 63.

3. The nucleic acid binding polypeptide according to claim 1, wherein at least one of said modules coming from the proteins E5AV36, E5AW43, and E5AW45, comprises a unique variable amino acid residue that determines the specificity of each module towards a nucleotide base.

4. The nucleic acid binding polypeptide according to claim 3, wherein said unique variable amino acid residue determines specificity to the following nucleotide base(s):

| Unique variable AA residue | Nucleotide base |
|---|---|
| I, S, T | A |
| G, R | T |
| D, T, * | C |
| N, R | G | where * represents a deletion.

5. The nucleic acid binding polypeptide according to claim 3, wherein said variable residue is located in position 13 of each module.

6. The nucleic acid binding polypeptide according to claim 1, wherein at least one of said modules coming from the proteins E5AV36, ESAW43, and E5AW45, comprise(s) variable residues in position 12 and 13 selected from the group consisting of NT, **, KCB NR, HH, HS, and RN, which determine the specificity of said module towards a nucleotide base, where * represents a deletion.

7. The nucleic acid binding polypeptide according to claim 1, wherein said polypeptide further comprises a module that has at least 80% amino acid identity with an AvrBs3 repeat of SEQ ID NO: 10.

8. . The polypeptide according to claim 1, further comprising a polypeptide sequence having at least 80% sequence identity with the C-terminal or N-terminal polypeptide from AvrBs3 (SEQ ID NO:6 or SEQ ID NO:111).

9. A therapeutic composition comprising the polypeptide according to claim 1 and a pharmaceutically acceptable carrier.

10. A polynucleotide encoding a polypeptide according to claim 1, which optionally, may be a DNA vector, an RNA vector, a plasmid or virus polynucleotide.

11. The nucleic acid binding polypeptide according to claim 1, wherein the nucleic acid binding polypeptide comprises a succession of at least 16 modules.

12. The nucleic acid binding polypeptide according to claim 1, wherein the nucleic acid binding polypeptide comprises a succession of at least 18 modules.

13. The nucleic acid binding polypeptide according to claim 1, wherein the nucleic acid binding polypeptide comprises a succession of at least 20 modules.

* * * * *

UNITED STATES PATENT AND TRADEMARK OFFICE
CERTIFICATE OF CORRECTION

PATENT NO. : 10,472,396 B2
APPLICATION NO. : 14/696920
DATED : November 12, 2019
INVENTOR(S) : Bertonati et al.

Page 1 of 1

It is certified that error appears in the above-identified patent and that said Letters Patent is hereby corrected as shown below:

In the Claims

Column 95
Line 3, Claim 6, replace "KCB" with -- KG, --

Signed and Sealed this
Seventh Day of April, 2020

Andrei Iancu
*Director of the United States Patent and Trademark Office*